US010179819B2

(12) United States Patent
Kirshner et al.

(10) Patent No.: US 10,179,819 B2
(45) Date of Patent: Jan. 15, 2019

(54) ANTI-PSMA ANTIBODIES, BISPECIFIC ANTIGEN-BINDING MOLECULES THAT BIND PSMA AND CD3, AND USES THEREOF

(71) Applicant: Regeneron Pharmaceuticals, Inc., Tarrytown, NY (US)

(72) Inventors: Jessica R. Kirshner, New York, NY (US); Alison Crawford, Dobbs Ferry, NY (US); Gavin Thurston, Briarcliff Manor, NY (US); Eric Smith, New York, NY (US); Lauric Haber, Rye Brook, NY (US); Drew Dudgeon, Union, NJ (US); Ashique Rafique, Yonkers, NY (US)

(73) Assignee: Regeneron Pharmaceuticals, Inc., Tarrytown, NY (US)

(*) Notice: Subject to any disclaimer, the term of this patent is extended or adjusted under 35 U.S.C. 154(b) by 0 days.

(21) Appl. No.: 15/223,434

(22) Filed: Jul. 29, 2016

(65) Prior Publication Data

US 2017/0051074 A1 Feb. 23, 2017

Related U.S. Application Data

(60) Provisional application No. 62/199,823, filed on Jul. 31, 2015, provisional application No. 62/222,590, filed on Sep. 23, 2015, provisional application No. 62/351,823, filed on Jun. 17, 2016.

(51) Int. Cl.

| | |
|---|---|
| ***A61K 39/00*** | (2006.01) |
| ***C07K 16/30*** | (2006.01) |
| ***C07K 16/28*** | (2006.01) |
| *A61K 39/395* | (2006.01) |

(52) U.S. Cl.

CPC ...... *C07K 16/3069* (2013.01); *C07K 16/2809* (2013.01); *A61K 39/39558* (2013.01); *A61K 2039/505* (2013.01); *C07K 2317/31* (2013.01); *C07K 2317/33* (2013.01); *C07K 2317/56* (2013.01); *C07K 2317/565* (2013.01); *C07K 2317/73* (2013.01); *C07K 2317/92* (2013.01)

(58) Field of Classification Search

CPC .................... A61K 39/39558; A61K 2039/505

See application file for complete search history.

(56) References Cited

U.S. PATENT DOCUMENTS

| | | | | |
|---|---|---|---|---|
| 5,162,504 | A | 11/1992 | Horoszewicz | |
| 6,107,090 | A | 8/2000 | Bander | |
| 6,136,311 | A | 10/2000 | Bander | |
| 6,150,508 | A | 11/2000 | Murphy et al. | |
| 6,649,163 | B1 | 11/2003 | Bander | |
| 6,962,981 | B1 | 11/2005 | Murphy et al. | |
| 7,045,605 | B2 | 5/2006 | Bander et al. | |
| 7,105,159 | B1 | 9/2006 | Israeli et al. | |
| 7,163,680 | B2 | 1/2007 | Bander | |
| 7,201,900 | B2 | 4/2007 | Murphy et al. | |
| 7,514,078 | B2 | 4/2009 | Bander et al. | |
| 7,666,414 | B2 | 2/2010 | Bander | |
| 7,666,425 | B1 | 2/2010 | Bander | |
| 2011/0293619 | A1 | 12/2011 | Kufer et al. | |
| 2014/0088295 | A1* | 3/2014 | Smith | C07K 16/2809 530/387.3 |
| 2014/0243504 | A1 | 8/2014 | Davis et al. | |
| 2015/0266966 | A1* | 9/2015 | Smith | C07K 16/2887 424/136.1 |

FOREIGN PATENT DOCUMENTS

| | | |
|---|---|---|
| WO | WO 10/037836 A2 | 4/2010 |
| WO | WO 11/121110 A1 | 10/2011 |
| WO | WO 13/145714 A1 | 10/2013 |
| WO | WO 13/158856 A2 | 10/2013 |

OTHER PUBLICATIONS

Buhler et al. (Cancer Immunol Immunother. Jan. 2008; 57 (1): 43-52).*

Jackman et al. (J. Biol. Chem. Jul. 2, 2010; 285 (27): 20850-9).*

Baum et al., "Antitumor activities of PSMAxCD3 diabodies by redirected T-cell lysis of prostate cancer cells," Immunotherapy, 5(1):27-38, (2013).

Buhler et al., "A bispecific diabody directed against prostate-specific membrane antigen and CD3 induces T-cell mediated lysis of prostate cancer cells," Cancer Immunology Immunother, 57(1):43-52, doi: 10.1007/S00262-007-0348-6, (2007).

Fortmuller et al., "Effective targeting of prostate cancer by lymphocytes redirected by a PSMA × CD3 bispecific single-chain diabody," Prostate, 71(6):588-596, (2011).

Friedrich, "Subcutaneous administration of PSMA/CD3-bispecific BITE antibody MT112/BAY 2010112 leads to complete remission of human prostate cancer xenografts in mice," Cancer Research, In: Proceedings of the 103rd Annual Meeting of AACR, 72(8 Suppl):Abstract No. 3526, doi: 10.1158/1538-7445.AM2012-3526, (2012).

(Continued)

*Primary Examiner* — Stephen L Rawlings

(74) *Attorney, Agent, or Firm* — Schwabe, Williamson & Wyatt PC; Mary C. Johnson

(57) ABSTRACT

The present invention provides antibodies that bind to prostate-specific membrane antigen (PSMA), bispecific antibodies that bind to PSMA and CD3, and methods of using the same. According to certain embodiments, the antibodies of the invention bind human PSMA with high affinity and bind CD3 to induce human T cell proliferation. The invention includes antibodies that bind PSMA and CD3 and induce T cell-mediated killing of PSMA-expressing tumor cells. According to certain embodiments, the present invention provides bispecific antigen-binding molecules comprising a first antigen-binding domain that specifically binds human CD3, and a second antigen-binding molecule that specifically binds human PSMA. In certain embodiments, the bispecific antigen-binding molecules of the present invention are capable of inhibiting the growth of prostate tumors expressing PSMA. The antibodies and bispecific antigen-binding molecules of the invention are useful for the treatment of diseases and disorders in which an upregulated or induced targeted immune response is desired and/or therapeutically beneficial. For example, the antibodies of the invention are useful for the treatment of various cancers.

12 Claims, 6 Drawing Sheets

Specification includes a Sequence Listing.

(56) References Cited

OTHER PUBLICATIONS

Israeli et al., “Molecular Cloning of a Complementary DNA Encoding a Prostate-specific Membrane Antigen,” Cancer Research, 53:227-230, (1993).

Lutlutterbuese et al., “Preclinical characterization of MT112/BAY 2010112, a novel PSMA/CD3-bispecific BITE antibody for the treatment of prostate cancer,” Cancer Research, In: Proceedings of the 102nd Annual Meeting of AACR, 71(8 Suppl):Abstract No. 4561, doi:10.1158/1538-7445.AM2011-4561, (2011).

Troyer et al., “Biochemical Characterization and Mapping of the 7E I I -05.3 Epitope of the Prostate-Specific Membrane Antigen,” Urol Oncol , 1:29-37, (1995).

WIPO Application No. PCT/US2016/044732, PCT International Search Report and Written Opinion of the International Searching Authority dated Oct. 13, 2016.

Friedrich et al., “Regression of Human Prostate Cancer Xenografts in Mice by AMG 212/BAY2010112, a Novel PSMA/CD3-Bispecific BiTE Antibody Cross-Reactive with Non-Human Primate Antigens,” Molecular Cancer Therapeutics, vol. 11(12): Dec. 2012; 11 pages. [Retrieved from the Internet on Jul. 13, 2015: <URL: http://mct.aacrjournals.org>].

Sewell et al., “Anti-PSMA × Anti-CD3 Bispecific Antibody Redirects T Cell Cytotoxicity in Castrate-Resistant Prostate Cancer Models,” Emergent Product Development, EORTC-NCI-AACR Symposium on Molecular Targets and Cancer Therapeutics; Nov. 6-9, 2012; Dublin, Ireland.

* cited by examiner

ANTI-PSMA ANTIBODIES, BISPECIFIC ANTIGEN-BINDING MOLECULES THAT BIND PSMA AND CD3, AND USES THEREOF

CROSS-REFERENCE TO RELATED APPLICATIONS

This application claims the benefit under 35 USC § 119(e) of U.S. Provisional Application Nos. 61/199,823, filed Jul. 31, 2015, 62/222,590, filed Sep. 23, 2015, and 62/351,823, filed Jun. 17, 2016, each of which is herein incorporated by reference.

REFERENCE TO A SEQUENCE LISTING

This application incorporates by reference the Sequence Listing submitted in Computer Readable Form as file 10173US01_seqlisting.txt, created on Jul. 22, 2016 and containing 630,026 bytes.

FIELD OF THE INVENTION

The present invention relates to antibodies, and antigen-binding fragments thereof, which are specific for prostate-specific membrane antigen (PSMA), and methods of use thereof. The present invention also relates to bispecific antigen-binding molecules that bind PSMA and CD3, and methods of use thereof.

BACKGROUND

Prostate-specific membrane antigen (PSMA), also known as folate hydrolase 1 (FOLH1), is an integral, non-shed membrane glycoprotein that is highly expressed in prostate epithelial cells and is a cell-surface marker for prostate cancer. Its expression is maintained in castrate-resistant prostate cancer, a condition with poor outcome and limited treatment options. Methods for treating prostate cancer by targeting PSMA have been investigated. For example, Yttrium-90 capromab is a radiotherapeutic comprising a monoclonal antibody to an intracellular epitope of PSMA. In another example, J591, a monoclonal antibody to an extracellular epitope of PSMA, is part of the radiotherapeutic Lutetium-177 J591 and in MLN2704, in which maytansinoid 1 (DM1, an antimicrotubule agent) is conjugated to J591. These therapies have been associated with toxicity. PSMA is also expressed within the neovasculature of other tumors such as bladder, renal, gastric, and colorectal carcinomas.

CD3 is a homodimeric or heterodimeric antigen expressed on T cells in association with the T cell receptor complex (TCR) and is required for T cell activation. Functional CD3 is formed from the dimeric association of two of four different chains: epsilon, zeta, delta and gamma. The CD3 dimeric arrangements include gamma/epsilon, delta/epsilon and zeta/zeta. Antibodies against CD3 have been shown to cluster CD3 on T cells, thereby causing T cell activation in a manner similar to the engagement of the TCR by peptide-loaded MHC molecules. Thus, anti-CD3 antibodies have been proposed for therapeutic purposes involving the activation of T cells. In addition, bispecific antibodies that are capable of binding CD3 and a target antigen have been proposed for therapeutic uses involving targeting T cell immune responses to tissues and cells expressing the target antigen.

Antigen-binding molecules that target PSMA, as well as bispecific antigen-binding molecules that bind both PSMA and CD3 would be useful in therapeutic settings in which specific targeting and T cell-mediated killing of cells that express PSMA is desired.

BRIEF SUMMARY OF THE INVENTION

In a first aspect, the present invention provides antibodies and antigen-binding fragments thereof that bind to human PSMA. The antibodies according to this aspect of the invention are useful, inter alia, for targeting cells expressing PSMA. The present invention also provides bispecific antibodies and antigen-binding fragments thereof that bind human PSMA and human CD3. The bispecific antibodies according to this aspect of the invention are useful, inter alia, for targeting T cells expressing CD3, and for stimulating T cell activation, e.g., under circumstances where T cell-mediated killing of cells expressing PSMA is beneficial or desirable. For example, the bispecific antibodies can direct CD3-mediated T cell activation to specific PSMA-expressing cells, such as prostate tumor cells.

Exemplary anti-PSMA antibodies of the present invention are listed in Tables 1 and 2 herein. Table 1 sets forth the amino acid sequence identifiers of the heavy chain variable regions (HCVRs) and light chain variable regions (LCVRs), as well as heavy chain complementarity determining regions (HCDR1, HCDR2 and HCDR3), and light chain complementarity determining regions (LCDR1, LCDR2 and LCDR3) of the exemplary anti-PSMA antibodies. Table 2 sets forth the sequence identifiers of the nucleic acid molecules encoding the HCVRs, LCVRs, HCDR1, HCDR2 HCDR3, LCDR1, LCDR2 and LCDR3 of the exemplary anti-PSMA antibodies.

The present invention provides antibodies, or antigen-binding fragments thereof, comprising an HCVR comprising an amino acid sequence selected from any of the HCVR amino acid sequences listed in Table 1, or a substantially similar sequence thereof having at least 90%, at least 95%, at least 98% or at least 99% sequence identity thereto.

The present invention also provides antibodies, or antigen-binding fragments thereof, comprising an LCVR comprising an amino acid sequence selected from any of the LCVR amino acid sequences listed in Table 1, or a substantially similar sequence thereof having at least 90%, at least 95%, at least 98% or at least 99% sequence identity thereto.

The present invention also provides antibodies, or antigen-binding fragments thereof, comprising an HCVR and an LCVR amino acid sequence pair (HCVR/LCVR) comprising any of the HCVR amino acid sequences listed in Table 1 paired with any of the LCVR amino acid sequences listed in Table 1. According to certain embodiments, the present invention provides antibodies, or antigen-binding fragments thereof, comprising an HCVR/LCVR amino acid sequence pair contained within any of the exemplary anti-PSMA antibodies listed in Table 1. In certain embodiments, the HCVR/LCVR amino acid sequence pair is selected from the group consisting of SEQ ID NOs: 66/1642 (e.g., H1H11810P2); and 122/130 (e.g., H1H3465P).

The present invention also provides antibodies, or antigen-binding fragments thereof, comprising a heavy chain CDR1 (HCDR1) comprising an amino acid sequence selected from any of the HCDR1 amino acid sequences listed in Table 1 or a substantially similar sequence thereof having at least 90%, at least 95%, at least 98% or at least 99% sequence identity.

The present invention also provides antibodies, or antigen-binding fragments thereof, comprising a heavy chain CDR2 (HCDR2) comprising an amino acid sequence selected from any of the HCDR2 amino acid sequences listed in Table 1 or a substantially similar sequence thereof having at least 90%, at least 95%, at least 98% or at least 99% sequence identity.

The present invention also provides antibodies, or antigen-binding fragments thereof, comprising a heavy chain CDR3 (HCDR3) comprising an amino acid sequence selected from any of the HCDR3 amino acid sequences listed in Table 1 or a substantially similar sequence thereof having at least 90%, at least 95%, at least 98% or at least 99% sequence identity.

The present invention also provides antibodies, or antigen-binding fragments thereof, comprising a light chain CDR1 (LCDR1) comprising an amino acid sequence selected from any of the LCDR1 amino acid sequences listed in Table 1 or a substantially similar sequence thereof having at least 90%, at least 95%, at least 98% or at least 99% sequence identity.

The present invention also provides antibodies, or antigen-binding fragments thereof, comprising a light chain CDR2 (LCDR2) comprising an amino acid sequence selected from any of the LCDR2 amino acid sequences listed in Table 1 or a substantially similar sequence thereof having at least 90%, at least 95%, at least 98% or at least 99% sequence identity.

The present invention also provides antibodies, or antigen-binding fragments thereof, comprising a light chain CDR3 (LCDR3) comprising an amino acid sequence selected from any of the LCDR3 amino acid sequences listed in Table 1 or a substantially similar sequence thereof having at least 90%, at least 95%, at least 98% or at least 99% sequence identity.

The present invention also provides antibodies, or antigen-binding fragments thereof, comprising an HCDR3 and an LCDR3 amino acid sequence pair (HCDR3/LCDR3) comprising any of the HCDR3 amino acid sequences listed in Table 1 paired with any of the LCDR3 amino acid sequences listed in Table 1. According to certain embodiments, the present invention provides antibodies, or antigen-binding fragments thereof, comprising an HCDR3/LCDR3 amino acid sequence pair contained within any of the exemplary anti-PSMA antibodies listed in Table 1. In certain embodiments, the HCDR3/LCDR3 amino acid sequence pair is selected from the group consisting of SEQ ID NOs: 72/1648 (e.g., H1H11810P2) and 128/136 (e.g., H1H3465P).

The present invention also provides antibodies, or antigen-binding fragments thereof, comprising a set of six CDRs (i.e., HCDR1-HCDR2-HCDR3-LCDR1-LCDR2-LCDR3) contained within any of the exemplary anti-PSMA antibodies listed in Table 1. In certain embodiments, the HCDR1-HCDR2-HCDR3-LCDR1-LCDR2-LCDR3 amino acid sequences set is selected from the group consisting of SEQ ID NOs: 68-70-72-1644-1646-1648 (e.g., H1H11810P2); and 124-126-128-132-134-136 (e.g., H1H3465P).

In a related embodiment, the present invention provides antibodies, or antigen-binding fragments thereof, comprising a set of six CDRs (i.e., HCDR1-HCDR2-HCDR3-LCDR1-LCDR2-LCDR3) contained within an HCVR/LCVR amino acid sequence pair as defined by any of the exemplary anti-PSMA antibodies listed in Table 1. For example, the present invention includes antibodies, or antigen-binding fragments thereof, comprising the HCDR1-HCDR2-HCDR3-LCDR1-LCDR2-LCDR3 amino acid sequences set contained within an HCVR/LCVR amino acid sequence pair selected from the group consisting of SEQ ID NOs: 66/146 (e.g., H1H11810P2); and 122/130 (e.g., H1H3465P). Methods and techniques for identifying CDRs within HCVR and LCVR amino acid sequences are well known in the art and can be used to identify CDRs within the specified HCVR and/or LCVR amino acid sequences disclosed herein. Exemplary conventions that can be used to identify the boundaries of CDRs include, e.g., the Kabat definition, the Chothia definition, and the AbM definition. In general terms, the Kabat definition is based on sequence variability, the Chothia definition is based on the location of the structural loop regions, and the AbM definition is a compromise between the Kabat and Chothia approaches. See, e.g., Kabat, "Sequences of Proteins of Immunological Interest," National Institutes of Health, Bethesda, Md. (1991); Al-Lazikani et al., *J. Mol. Biol.* 273:927-948 (1997); and Martin et al., *Proc. Natl. Acad. Sci. USA* 86:9268-9272 (1989). Public databases are also available for identifying CDR sequences within an antibody.

The present invention also provides nucleic acid molecules encoding anti-PSMA antibodies or portions thereof. For example, the present invention provides nucleic acid molecules encoding any of the HCVR amino acid sequences listed in Table 1; in certain embodiments the nucleic acid molecule comprises a polynucleotide sequence selected from any of the HCVR nucleic acid sequences listed in Table 2, or a substantially similar sequence thereof having at least 90%, at least 95%, at least 98% or at least 99% sequence identity thereto.

The present invention also provides nucleic acid molecules encoding any of the LCVR amino acid sequences listed in Table 1; in certain embodiments the nucleic acid molecule comprises a polynucleotide sequence selected from any of the LCVR nucleic acid sequences listed in Table 2, or a substantially similar sequence thereof having at least 90%, at least 95%, at least 98% or at least 99% sequence identity thereto.

The present invention also provides nucleic acid molecules encoding any of the HCDR1 amino acid sequences listed in Table 1; in certain embodiments the nucleic acid molecule comprises a polynucleotide sequence selected from any of the HCDR1 nucleic acid sequences listed in Table 2, or a substantially similar sequence thereof having at least 90%, at least 95%, at least 98% or at least 99% sequence identity thereto.

The present invention also provides nucleic acid molecules encoding any of the HCDR2 amino acid sequences listed in Table 1; in certain embodiments the nucleic acid molecule comprises a polynucleotide sequence selected from any of the HCDR2 nucleic acid sequences listed in Table 2, or a substantially similar sequence thereof having at least 90%, at least 95%, at least 98% or at least 99% sequence identity thereto.

The present invention also provides nucleic acid molecules encoding any of the HCDR3 amino acid sequences listed in Table 1; in certain embodiments the nucleic acid molecule comprises a polynucleotide sequence selected from any of the HCDR3 nucleic acid sequences listed in Table 2, or a substantially similar sequence thereof having at least 90%, at least 95%, at least 98% or at least 99% sequence identity thereto.

The present invention also provides nucleic acid molecules encoding any of the LCDR1 amino acid sequences listed in Table 1; in certain embodiments the nucleic acid molecule comprises a polynucleotide sequence selected from any of the LCDR1 nucleic acid sequences listed in Table 2, or a substantially similar sequence thereof having at least 90%, at least 95%, at least 98% or at least 99% sequence identity thereto.

The present invention also provides nucleic acid molecules encoding any of the LCDR2 amino acid sequences listed in Table 1; in certain embodiments the nucleic acid molecule comprises a polynucleotide sequence selected from any of the LCDR2 nucleic acid sequences listed in Table 2, or a substantially similar sequence thereof having at least 90%, at least 95%, at least 98% or at least 99% sequence identity thereto.

The present invention also provides nucleic acid molecules encoding any of the LCDR3 amino acid sequences listed in Table 1; in certain embodiments the nucleic acid molecule comprises a polynucleotide sequence selected from any of the LCDR3 nucleic acid sequences listed in Table 2, or a substantially similar sequence thereof having at least 90%, at least 95%, at least 98% or at least 99% sequence identity thereto.

The present invention also provides nucleic acid molecules encoding an HCVR, wherein the HCVR comprises a set of three CDRs (i.e., HCDR1-HCDR2-HCDR3), wherein the HCDR1-HCDR2-HCDR3 amino acid sequence set is as defined by any of the exemplary anti-PSMA antibodies listed in Table 1.

The present invention also provides nucleic acid molecules encoding an LCVR, wherein the LCVR comprises a set of three CDRs (i.e., LCDR1-LCDR2-LCDR3), wherein the LCDR1-LCDR2-LCDR3 amino acid sequence set is as defined by any of the exemplary anti-PSMA antibodies listed in Table 1.

The present invention also provides nucleic acid molecules encoding both an HCVR and an LCVR, wherein the HCVR comprises an amino acid sequence of any of the HCVR amino acid sequences listed in Table 1, and wherein the LCVR comprises an amino acid sequence of any of the LCVR amino acid sequences listed in Table 1. In certain embodiments, the nucleic acid molecule comprises a polynucleotide sequence selected from any of the HCVR nucleic acid sequences listed in Table 2, or a substantially similar sequence thereof having at least 90%, at least 95%, at least 98% or at least 99% sequence identity thereto, and a polynucleotide sequence selected from any of the LCVR nucleic acid sequences listed in Table 2, or a substantially similar sequence thereof having at least 90%, at least 95%, at least 98% or at least 99% sequence identity thereto. In certain embodiments according to this aspect of the invention, the nucleic acid molecule encodes an HCVR and LCVR, wherein the HCVR and LCVR are both derived from the same anti-PSMA antibody listed in Table 1.

The present invention also provides recombinant expression vectors capable of expressing a polypeptide comprising a heavy or light chain variable region of an anti-PSMA antibody. For example, the present invention includes recombinant expression vectors comprising any of the nucleic acid molecules mentioned above, i.e., nucleic acid molecules encoding any of the HCVR, LCVR, and/or CDR sequences as set forth in Table 1. Also included within the scope of the present invention are host cells into which such vectors have been introduced, as well as methods of producing the antibodies or portions thereof by culturing the host cells under conditions permitting production of the antibodies or antibody fragments, and recovering the antibodies and antibody fragments so produced.

The present invention includes anti-PSMA antibodies having a modified glycosylation pattern. In some embodiments, modification to remove undesirable glycosylation sites may be useful, or an antibody lacking a fucose moiety present on the oligosaccharide chain, for example, to increase antibody dependent cellular cytotoxicity (ADCC) function (see Shield et al. (2002) JBC 277:26733). In other applications, modification of galactosylation can be made in order to modify complement dependent cytotoxicity (CDC).

In another aspect, the invention provides a pharmaceutical composition comprising a recombinant human antibody or fragment thereof which specifically binds PSMA and a pharmaceutically acceptable carrier. In a related aspect, the invention features a composition which is a combination of an anti-PSMA antibody and a second therapeutic agent. In one embodiment, the second therapeutic agent is any agent that is advantageously combined with an anti-PSMA antibody. Additional combination therapies and co-formulations involving the anti-PSMA antibodies of the present invention are disclosed elsewhere herein.

In another aspect, the invention provides therapeutic methods for targeting/killing tumor cells expressing PSMA using an anti-PSMA antibody of the invention, wherein the therapeutic methods comprise administering a therapeutically effective amount of a pharmaceutical composition comprising an anti-PSMA antibody of the invention to a subject in need thereof. In some cases, the anti-PSMA antibodies (or antigen-binding fragments thereof) can be used for treating prostate cancer, or may be modified to be more cytotoxic by methods, including but not limited to, modified Fc domains to increase ADCC (see e.g. Shield et al. (2002) JBC 277:26733), radioimmunotherapy (Akhtar, et al., 2012, Prostate-Specific Membrane Antigen-Based Therapeutics; Adv Urol. 2012: 973820), antibody-drug conjugates (Olson, W C and Israel, R J, 2014, Front Biosci (Landmark Ed). 19:12-33; DiPippo, et al. Feb. 15, 2015, The Prostate, 75(3):303-313, first published on line Oct. 18, 2014), or other methods for increasing the efficiency of tumor ablation.

The present invention also includes the use of an anti-PSMA antibody of the invention in the manufacture of a medicament for the treatment of a disease or disorder related to or caused by PSMA-expressing cells.

In yet another aspect, the invention provides monospecific anti-PSMA antibodies for diagnostic applications, such as, e.g., imaging reagents.

In yet another aspect, the invention provides therapeutic methods for stimulating T cell activation using an anti-CD3 antibody or antigen-binding portion of an antibody of the invention, wherein the therapeutic methods comprise administering a therapeutically effective amount of a pharmaceutical composition comprising an antibody In another aspect, the present invention provides an isolated antibody or antigen-binding fragment thereof that binds human prostate-specific membrane antigen (PSMA) with a binding dissociation equilibrium constant ($K_D$) of less than about 80 nM as measured in a surface plasmon resonance assay at 37° C. In yet another aspect, the present invention provides an isolated antibody or antigen-binding fragment thereof that binds human PSMA with a dissociative half-life (t½) of greater than about 10 minutes as measured in a surface plasmon resonance assay at 37° C.

The invention further provides an antibody or antigen-binding fragment that competes for binding to human PSMA with a reference antibody comprising an HCVR/LCVR amino acid sequence pair as set forth in Table 1. In another aspect, the invention provides an antibody or antigen-binding fragment that competes for binding to human PSMA with a reference antibody comprising an HCVR/LCVR amino acid sequence pair selected from the group consisting of SEQ ID NOs: 2/1642; 10/1642; 18/1642; 26/1642; 34/1642; 42/1642; 50/1642; 58/1642; 66/1642; 74/1642; 82/1642; 90/1642; 98/1642; 106/1642; 114/1642; 122/130; and 138/146.

The invention furthermore provides an antibody or antigen-binding fragment, wherein the antibody or antigen-binding fragment thereof binds to the same epitope on human PSMA as a reference antibody comprising an HCVR/LCVR amino acid sequence pair as set forth in Table 1. In another aspect, the antibody or antigen-binding fragment binds to the same epitope on human PSMA as a reference antibody comprising an HCVR/LCVR amino acid sequence pair selected from the group consisting of SEQ ID NOs:2/1642; 10/1642; 18/1642; 26/1642; 34/1642; 42/1642; 50/1642; 58/1642; 66/1642; 74/1642; 82/1642; 90/1642; 98/1642; 106/1642; 114/1642; 122/130; and 138/146.

The invention further provides an isolated antibody or antigen-binding fragment thereof that binds human PSMA, wherein the antibody or antigen-binding fragment comprises: the complementarity determining regions (CDRs) of a heavy chain variable region (HCVR) having an amino acid sequence as set forth in Table 1; and the CDRs of a light chain variable region (LCVR) having an amino acid sequence as set forth in Table 1. In another aspect, the isolated antibody or antigen-binding fragment comprises the heavy and light chain CDRs of a HCVR/LCVR amino acid sequence pair selected from the group consisting of: SEQ ID NOs:2/1642; 10/1642; 18/1642; 26/1642; 34/1642; 42/1642; 50/1642; 58/1642; 66/1642; 74/1642; 82/1642; 90/1642; 98/1642; 106/1642; 114/1642; 122/130; and 138/146. In yet another aspect, the isolated antibody or antigen-binding fragment comprises HCDR1-HCDR2-HCDR3-LCDR1-LCDR2-LCDR3 domains, respectively, selected from the group consisting of: SEQ ID NOs: 4-6-8-1644-1646-1648; 12-14-16-1644-1646-1648; 20-22-24-1644-1646-1648; 28-30-32-1644-1646-1648; 36-38-40-1644-1646-1648; 44-46-48-1644-1646-1648; 52-54-56-1644-1646-1648; 60-62-64-1644-1646-1648; 68-70-72-1644-1646-1648; 76-78-80-1644-1646-1648; 84-86-88-1644-1646-1648; 92-94-96-1644-1646-1648; 100-102-104-1644-1646-1648; 108-110-112-1644-1646-1648; 116-118-120-1644-1646-1648; 124-126-128-132-134-136; and 140-142-144-148-150-152.

In another aspect, the invention provides an isolated antibody or antigen-binding fragment thereof that binds human PSMA, wherein the antibody or antigen-binding fragment comprises: (a) a heavy chain variable region (HCVR) having an amino acid sequence selected from the group consisting of SEQ ID NOs: 2, 10, 18, 26, 34, 42, 50, 58, 66, 74, 82, 90, 98, 106, 114, 122, and 138; and (b) a light chain variable region (LCVR) having an amino acid sequence selected from the group consisting of SEQ ID NOs: 130 and 146. In a further aspect, the isolated antibody or antigen-binding fragment of claim 10, wherein the antibody or antigen-binding fragment comprises a HCVR/LCVR amino acid sequence pair selected from the group consisting of: SEQ ID NOs:2/1642; 10/1642; 18/1642; 26/1642; 34/1642; 42/1642; 50/1642; 58/1642; 66/1642; 74/1642; 82/1642; 90/1642; 98/1642; 106/1642; 114/1642; 122/130; and 138/146.

According to another aspect, the present invention provides bispecific antigen-binding molecules (e.g., antibodies) that bind PSMA and CD3. Such bispecific antigen-binding molecules are also referred to herein as "anti-PSMA/anti-CD3 bispecific molecules," "anti-CD3/anti-PSMA bispecific molecules," or "PSMA×CD3 bsAbs." The anti-PSMA portion of the anti-PSMA/anti-CD3 bispecific molecule is useful for targeting cells (e.g., tumor cells) that express PSMA (e.g., prostate tumors), and the anti-CD3 portion of the bispecific molecule is useful for activating T-cells. The simultaneous binding of PSMA on a tumor cell and CD3 on a T-cell facilitates directed killing (cell lysis) of the targeted tumor cell by the activated T-cell. The anti-PSMA/anti-CD3 bispecific molecules of the invention are therefore useful, inter alia, for treating diseases and disorders related to or caused by PSMA-expressing tumors (e.g., prostate cancers).

The bispecific antigen-binding molecules according to this aspect of the present invention comprise a first antigen-binding domain that specifically binds human CD3, and a second antigen-binding domain that specifically binds PSMA. The present invention includes anti-PSMA/anti-CD3 bispecific molecules (e.g., bispecific antibodies) wherein each antigen-binding domain comprises a heavy chain variable region (HCVR) paired with a light chain variable region (LCVR). In certain exemplary embodiments of the invention, the anti-CD3 antigen-binding domain and the anti-PSMA antigen binding domain each comprise different, distinct HCVRs paired with a common LCVR. For example, as illustrated in Example 4 herein, bispecific antibodies were constructed comprising a first antigen-binding domain that specifically binds CD3, wherein the first antigen-binding domain comprises an HCVR/LCVR pair derived from an anti-CD3 antibody; and a second antigen-binding domain that specifically binds PSMA, wherein the second antigen-binding domain comprises an HCVR derived from an anti-PSMA antibody paired with an LCVR derived from an anti-CD3 antibody (e.g., the same LCVR that is included in the anti-CD3 antigen-binding domain). In other words, in the exemplary molecules disclosed herein, the pairing of an HCVR from an anti-PSMA antibody with an LCVR from an anti-CD3 antibody creates an antigen-binding domain that specifically binds PSMA (but does not bind CD3). In such embodiments, the first and second antigen-binding domains comprise distinct anti-CD3 and anti-PSMA HCVRs but share a common anti-CD3 LCVR. In other embodiments, the bispecific antigen-binding molecules comprise distinct anti-CD3 and anti-PSMA HCVRs, but share a common LCVR. The amino acid sequence of this LCVR is shown, e.g., in SEQ ID NO:1642, and the amino acid sequences of the corresponding CDRs (i.e., LCDR1-LCDR2-LCDR3) are shown in SEQ ID NOs: 1644, 1646 and 1648, respectively. Genetically modified mice can be used to produce fully human bispecific antigen-binding molecules comprising two different heavy chains that associate with an identical light chain that comprises a variable domain derived from one of two different human light chain variable region gene segments. Alternatively, variable heavy chains may be paired with one common light chain and expressed recombinantly in host cells. As such, the antibodies of the invention can comprise immunoglobulin heavy chains associated with a single rearranged light chain. In some embodiments, the light chain comprises a variable domain derived from a human Vκ1-39 gene segment or a Vκ3-20 gene segment. In other embodiments, the light chain comprises a variable domain derived from a human Vκ1-39 gene segment rearranged with a human Jκ5 or a human Jκ1 gene segment.

The present invention provides anti-CD3/anti-PSMA bispecific molecules, wherein the first antigen-binding domain that specifically binds CD3 comprises any of the HCVR amino acid sequences, any of the LCVR amino acid sequences, any of the HCVR/LCVR amino acid sequence pairs, any of the heavy chain CDR1-CDR2-CDR3 amino acid sequences, or any of the light chain CDR1-CDR2-CDR3 amino acid sequences as set forth in US publication 2014/0088295.

In addition, the present invention provides anti-CD3/anti-PSMA bispecific molecules, wherein the first antigen-binding domain that specifically binds CD3 comprises any of the HCVR amino acid sequences as set forth in Tables 12, 14, and 18 herein. The first antigen-binding domain that specifically binds CD3 may also comprise any of the LCVR amino acid sequences as set forth in Tables 12, 15, and 20 herein. According to certain embodiments, the first antigen-binding domain that specifically binds CD3 comprises any of the HCVR/LCVR amino acid sequence pairs as set forth in Tables 12, 14, 15, 18, and 20 herein. The present invention also provides anti-CD3/anti-PSMA bispecific molecules, wherein the first antigen-binding domain that specifically binds CD3 comprises any of the heavy chain CDR1-CDR2-CDR3 amino acid sequences as set forth in Tables 12, 14, and 18 herein, and/or any of the light chain CDR1-CDR2-CDR3 amino acid sequences as set forth in Tables 12, 15, and 20 herein.

According to certain embodiments, the present invention provides anti-CD3/anti-PSMA bispecific molecules, wherein the first antigen-binding domain that specifically binds CD3 comprises a heavy chain variable region (HCVR) having an amino acid sequence as set forth in Tables 12, 14, and 18 herein or a substantially similar sequence thereof having at least 90%, at least 95%, at least 98% or at least 99% sequence identity.

The present invention also provides anti-CD3/anti-PSMA bispecific molecules, wherein the first antigen-binding domain that specifically binds CD3 comprises a light chain variable region (LCVR) having an amino acid sequence as set forth in Tables 12, 15, and 20 herein, or a substantially similar sequence thereof having at least 90%, at least 95%, at least 98% or at least 99% sequence identity.

The present invention also provides anti-CD3/anti-PSMA bispecific molecules, wherein the first antigen-binding domain that specifically binds CD3 comprises a HCVR and LCVR (HCVR/LCVR) amino acid sequence pair as set forth in Tables 12, 14, 15, 18, and 20 herein.

The present invention also provides anti-CD3/anti-PSMA bispecific molecules, wherein the first antigen-binding domain that specifically binds CD3 comprises a heavy chain CDR3 (HCDR3) domain having an amino acid sequence as set forth in Tables 12, 14, and 18 herein, or a substantially similar sequence thereto having at least 90%, at least 95%, at least 98% or at least 99% sequence identity; and a light chain CDR3 (LCDR3) domain having an amino acid sequence as set forth in Tables 12, 15, and 20 herein, or a substantially similar sequence thereof having at least 90%, at least 95%, at least 98% or at least 99% sequence identity.

In certain embodiments, the first antigen-binding domain that specifically binds CD3 comprises a HCDR3/LCDR3 amino acid sequence pair as set forth in Tables 12, 14, 15, 18, and 20 herein.

The present invention also provides anti-CD3/anti-PSMA bispecific antigen-binding molecules, wherein the first antigen-binding domain that specifically binds CD3 comprises a heavy chain CDR1 (HCDR1) domain having an amino acid as set forth in Tables 12, 14, and 18 herein, or a substantially similar sequence thereof having at least 90%, at least 95%, at least 98% or at least 99% sequence identity; a heavy chain CDR2 (HCDR2) domain having an amino acid as set forth in Tables 12, 14, and 18, or a substantially similar sequence thereof having at least 90%, at least 95%, at least 98% or at least 99% sequence identity; a heavy chain CDR3 (HCDR3) domain having an amino acid as set forth in Tables 12, 14, and 18, or a substantially similar sequence thereof having at least 90%, at least 95%, at least 98% or at least 99% sequence identity; a light chain CDR1 (LCDR1) domain having an amino acid sequence as set forth in Tables 12, 15, and 20 herein, or a substantially similar sequence thereof having at least 90%, at least 95%, at least 98% or at least 99% sequence identity; a light chain CDR2 (LCDR2) domain having an amino acid sequence as set forth in Tables 12, 15, and 20 herein, or a substantially similar sequence thereof having at least 90%, at least 95%, at least 98% or at least 99% sequence identity, and a light chain CDR3 (LCDR3) domain having an amino acid sequence as set forth in Tables 12, 15, and 20 herein, or a substantially similar sequence thereof having at least 90%, at least 95%, at least 98% or at least 99% sequence identity.

Certain non-limiting, exemplary anti-CD3/anti-PSMA bispecific antigen-binding molecules of the invention include a first antigen-binding domain that specifically binds CD3 comprising HCDR1-HCDR2-HCDR3-LCDR1-LCDR2-LCDR3 domains, respectively, having the amino acid sequences as set forth in Tables 12, 14, 15, 18, and 20 herein.

The present invention further provides a bispecific antigen-binding molecule, wherein the first antigen-binding domain that specifically binds human CD3 comprises heavy chain complementarity determining regions (HCDR1, HCDR2 and HCDR3) from a heavy chain variable region (HCVR) comprising an amino acid sequence as set forth in Table 12, Table 14, or Table 18 and light chain complementarity determining regions (LCDR1, LCDR2 and LCDR3) from a light chain variable region (LCVR) comprising an amino acid sequence as set forth in Table 12, Table 15, or Table 20.

In another aspect, the invention provides a bispecific antigen-binding molecule wherein the first antigen-binding domain that specifically binds human CD3 comprises heavy chain complementarity determining regions (HCDR1, HCDR2 and HCDR3) from a heavy chain variable region (HCVR) selected from the group consisting of SEQ ID NOs: 922, 154, 1482, 1490, 1498, 1506, 1514, 1522, 1530, 1538, 1546, 1554, 1562, 1570, 1578, 1586, 1594, 1602, 1610, 1618, and 1626, and light chain complementarity determining regions (LCDR1, LCDR2 and LCDR3) from a light chain variable region (LCVR) comprising an amino acid sequence selected from the group consisting of SEQ ID NOs: 162, 930 and 1642.

The invention further provides a bispecific antigen-binding molecule, wherein the first antigen-binding domain that specifically binds human CD3 comprises three heavy chain complementarity determining regions (A1-HCDR1, A1-HCDR2 and A1-HCDR3) and three light chain complementarity determining regions (A1-LCDR1, A1-LCDR2 and A1-LCDR3), wherein A1-HCDR1 comprises an amino acid sequence selected from the group consisting of SEQ ID NOs: 924, 156; 1484, 1492, 1500, 1508, 1516, 1524, 1532, 1540, 1548, 1556, 1564, 1572, 1580, 1588, 1596, 1604, 1612, 1620, and 1628; A1-HCDR2 comprises an amino acid sequence selected from the group consisting of SEQ ID NOs: 926, 158, 1486, 1494, 1502, 1510, 1518, 1526, 1534, 1542, 1550, 1558, 1566, 1574, 1582, 1590, 1598, 1606, 1614, 1622, and 1630; A1-HCDR3 comprises an amino acid sequence selected from the group consisting of SEQ ID NOs: 928, 160, 1488, 1496, 1504, 1512, 1520, 1528, 1536, 1544, 1552, 1560, 1568, 1576, 1584, 1592, 1600, 1608, 1616, 1624, and 1632; A1-LCDR1 comprises an amino acid sequence selected from the group consisting of SEQ ID NOs: 932, 164, and 1644; A1-LCDR2 comprises an amino acid sequence selected from the group consisting of SEQ ID NOs: 166, 934 and 1646; and A1-LCDR3 comprises an amino acid sequence selected from the group consisting of SEQ ID NOs: 168, 936 and 1648.

In a further aspect, the invention provides a bispecific antigen-binding molecule, wherein the first antigen-binding domain that specifically binds human CD3 comprises the heavy and light chain CDRs of a HCVR/LCVR amino acid sequence pair selected from the group consisting of: SEQ ID NOs: 922/930, 154/162, 1482/1642, 1490/1642, 1498/1642, 1506/1642, 1514/1642, 1522/1642, 1530/1642, 1538/1642, 1546/1642, 1554/1642, 1562/1642, 1570/1642, 1578/1642, 1586/1642, 1594/1642, 1602/1642, 1610/1642, 1618/1642, and 1626/1642

In another aspect, the invention provides a bispecific antigen-binding molecule, wherein the first antigen-binding domain that specifically binds human CD3 comprises three heavy chain complementarity determining regions (A1-HCDR1, A1-HCDR2 and A1-HCDR3) and three light chain complementarity determining regions (A1-LCDR1, A1-LCDR2 and A1-LCDR3), and wherein the second antigen-binding domain that specifically binds human PSMA comprises three heavy chain complementarity determining regions (A2-HCDR1, A2-HCDR2 and A2-HCDR3) and three light chain complementarity determining regions (A2-LCDR1, A2-LCDR2 and A2-LCDR3); wherein A1-HCDR1 comprises an amino acid sequence selected from the group consisting of SEQ ID NOs: 924, 156, 1484, 1492, 1500, 1508, 1516, 1524, 1532, 1540, 1548, 1556, 1564, 1572, 1580, 1588, 1596, 1604, 1612, 1620, and 1628; A1-HCDR2 comprises an amino acid sequence selected from the group consisting of SEQ ID NOs: 926, 158, 1486, 1494, 1502, 1510, 1518, 1526, 1534, 1542, 1550, 1558, 1566, 1574, 1582, 1590, 1598, 1606, 1614, 1622, and 1630; A1-HCDR3 comprises an amino acid sequence selected from the group consisting of SEQ ID NOs:928, 160, 1488, 1496, 1504, 1512, 1520, 1528, 1536, 1544, 1552, 1560, 1568, 1576, 1584, 1592, 1600, 1608, 1616, 1624, and 1632; A1-LCDR1 comprises an amino acid sequence selected from the group consisting of SEQ ID NOs: 164, 932, and 1644; A1-LCDR2 comprises an amino acid sequence selected from the group consisting of SEQ ID NOs: 166, 934, and 1646; and A1-LCDR3 comprises an amino acid sequence selected from the group consisting of SEQ ID NOs: 168, 936, and 1648; and wherein A2-HCDR1 comprises an amino acid sequence selected from the group consisting of SEQ ID NOs: 124 and 68; A2-HCDR2 comprises an amino acid sequence selected from the group consisting of SEQ ID NOs: 126 and 70; A2-HCDR3 comprises an amino acid sequence selected from the group consisting of SEQ ID NOs: 128 and 72; A2-LCDR1 comprises an amino acid sequence selected from the group consisting of SEQ ID NOs: 932, 164, and 1644; A2-LCDR2 comprises an amino acid sequence selected from the group consisting of SEQ ID NOs: 934, 166, and 1646; and A2-LCDR3 comprises an amino acid sequence selected from the group consisting of SEQ ID NOs: 936, 168, and 1648.

Certain non-limiting, exemplary anti-CD3/anti-PSMA bispecific antigen-binding molecules of the invention include a first antigen-binding domain that specifically binds CD3 comprising a heavy chain comprising variable domain framework regions having an amino acid sequence selected from FR1 (SEQ ID NO: 1654), FR2 (SEQ ID NO: 1656), FR3 (SEQ ID NO: 1657), and FR4 (SEQ ID NO: 1658).

In more embodiments, exemplary anti-CD3/anti-PSMA bispecific antigen-binding molecules of the invention include a bispecific antigen-binding molecule wherein the first antigen-binding domain that specifically binds human CD3 comprises a HCVR comprising HCDR1-HCDR2-HCDR3 having the amino acid sequences of SEQ ID NOs: 1659-1660-1661.

The present invention also provides anti-CD3/anti-PSMA bispecific molecules, wherein the second antigen-binding domain that specifically binds PSMA comprises a heavy chain variable region (HCVR) having the amino acid sequence selected from the group consisting of SEQ ID NOs:2, 10, 18, 26, 34, 42, 50, 58, 66, 74, 82, 90, 98, 106, 114, 122, and 138, or a substantially similar sequence thereof having at least 90%, at least 95%, at least 98% or at least 99% sequence identity.

The present invention also provides anti-CD3/anti-PSMA bispecific molecules, wherein the second antigen-binding domain that specifically binds PSMA comprises a light chain variable region (LCVR) having the amino acid sequence selected from the group consisting of SEQ ID NOs:930, 162, and 1642, or a substantially similar sequence thereof having at least 90%, at least 95%, at least 98% or at least 99% sequence identity.

The present invention also provides anti-CD3/anti-PSMA bispecific molecules, wherein the second antigen-binding domain that specifically binds PSMA comprises a HCVR and LCVR (HCVR/LCVR) amino acid sequence pair selected from the group consisting of SEQ ID NOs: 122/930, 122/162, and 66/1642.

The present invention also provides anti-CD3/anti-PSMA bispecific molecules, wherein the second antigen-binding domain that specifically binds PSMA comprises a heavy chain CDR3 (HCDR3) domain having an amino acid sequence selected from the group consisting of SEQ ID NOs:8, 16, 24, 32, 40, 48, 56, 64, 72, 80, 88, 96, 104, 112, 120, 128, and 144, or a substantially similar sequence thereto having at least 90%, at least 95%, at least 98% or at least 99% sequence identity; and a light chain CDR3 (LCDR3) domain having an amino acid sequence selected from the group consisting of SEQ ID NOs: 936, 168, and 1648, or a substantially similar sequence thereof having at least 90%, at least 95%, at least 98% or at least 99% sequence identity.

In certain embodiments, the second antigen-binding domain that specifically binds PSMA comprises a HCDR3/LCDR3 amino acid sequence pair selected from the group consisting of SEQ ID NOs: 128/936, 128/168, and 72/1648.

The present invention also provides anti-CD3/anti-PSMA bispecific antigen-binding molecules, wherein the second antigen-binding domain that specifically binds PSMA comprises a heavy chain CDR1 (HCDR1) domain having an amino acid sequence selected from the group consisting of SEQ ID NOs:4, 12, 20, 28, 36, 44, 52, 60, 68, 76, 84, 92, 100, 108, 116, 124, and 140, or a substantially similar sequence thereof having at least 90%, at least 95%, at least 98% or at least 99% sequence identity; a heavy chain CDR2 (HCDR2) domain having an amino acid sequence selected from the group consisting of SEQ ID NOs:6, 14, 22, 30, 38, 46, 54, 62, 70, 78, 86, 94, 102, 110, 118, 126 and 142, or a substantially similar sequence thereof having at least 90%, at least 95%, at least 98% or at least 99% sequence identity; a heavy chain CDR3 (HCDR3) domain having an amino acid sequence selected from the group consisting of SEQ ID NOs: 8, 16, 24, 32, 40, 48, 56, 64, 72, 80, 88, 96, 104, 112, 120, 128, and 144, or a substantially similar sequence thereof having at least 90%, at least 95%, at least 98% or at least 99% sequence identity; a light chain CDR1 (LCDR1) domain having an amino acid sequence selected from the group consisting of SEQ ID NOs: 932, 164, and 1644, or a substantially similar sequence thereof having at least 90%, at least 95%, at least 98% or at least 99% sequence identity; and a light chain CDR2 (LCDR2) domain having an amino acid sequence selected from the group consisting of SEQ ID NOs: 934, 166, and 1646, or a substantially similar sequence thereof having at least 90%, at least 95%, at least 98% or at least 99% sequence identity; and a light chain CDR3 (LCDR3) domain having an amino acid sequence selected from the group consisting of SEQ ID NOs: 936, 168, and 1648, or a substantially similar sequence thereof having at least 90%, at least 95%, at least 98% or at least 99% sequence identity.

Certain non-limiting, exemplary anti-CD3/anti-PSMA bispecific antigen-binding molecules of the invention include a second antigen-binding domain that specifically binds PSMA comprising HCDR1-HCDR2-HCDR3-LCDR1-LCDR2-LCDR3 domains, respectively, having the amino acid sequences selected from the group consisting of: SEQ ID NOs: 124-126-128-932-934-936, 124-126-128-164-166-168, and 68-70-72-1644-1646-1648.

In a related embodiment, the invention includes anti-CD3/anti-PSMA bispecific antigen-binding molecules wherein the second antigen-binding domain that specifically binds PSMA comprises the heavy and light chain CDR domains contained within heavy and light chain variable region (HCVR/LCVR) sequences selected from the group consisting of SEQ ID NOs: 122/930, 122/162, and 66/1642.

In another aspect, the invention provides a bispecific antigen-binding molecule comprising a first antigen-binding domain that binds human CD3 and a second antigen-binding domain that binds human PSMA, wherein the second antigen-binding domain is derived from the antibody or antigen-binding fragment of any one of the anti-PSMA antibodies of the invention. In a further aspect, the invention provides a bispecific antigen-binding molecule comprising a first antigen-binding domain that specifically binds human CD3, and a second antigen-binding domain that specifically binds human PSMA.

The invention further provides a bispecific antigen-binding molecule which binds human cells expressing human CD3 and cynomolgus monkey cells expressing cynomolgus CD3. In another aspect, the bispecific antigen-binding molecule binds human cells expressing human PSMA and cynomolgus monkey cells expressing cynomolgus PSMA.

In another aspect the invention provides a bispecific antigen-binding molecule which inhibits tumor growth in immunocompromised mice bearing human prostate cancer xenografts. The invention further provides a bispecific antigen-binding molecule which inhibits tumor growth in immunocompetent mice bearing human prostate cancer xenografts. The invention further provides a bispecific antigen-binding molecule which suppresses tumor growth of established tumors in immunocompromised mice bearing human prostate cancer xenografts. The invention further provides a bispecific antigen-binding molecule which reduces tumor growth of established tumors in immunocompetent mice bearing human prostate cancer xenografts.

In another aspect the invention provides a bispecific antigen-binding molecule comprising i) a first antigen-binding domain that specifically binds an effector cell with an $EC_{50}$ value of greater than about 40 nM and, and ii) a second antigen-binding domain that specifically binds a target human prostate tumor cell with an $EC_{50}$ value of less than 40 nM, wherein such $EC_{50}$ binding affinity value is measured in an in vitro FACS binding assay.

For example, the bispecific antigen-binding molecule can include a first antigen-binding domain that specifically binds human CD3 with an $EC_{50}$ value of greater than about 40 nM, or greater than about 100 nM, greater than about 200 nM, or greater than about 1 μM. In one embodiment, the bispecific antigen-binding molecule can include a second antigen-binding domain that specifically binds the target prostate tumor cell with an $EC_{50}$ value of less than about 6 nM. In some cases, the first antigen-binding domain specifically binds each of human CD3 and cynomolgus CD3 with an $EC_{50}$ value of greater than about 40 nM, greater than about 100 nM, greater than about 200 nM, or greater than about 1 μM. In some cases, the first antigen-binding domain specifically binds each of human CD3 and cynomolgus CD3 with weak or no measurable affinity.

In some embodiments, the antigen-binding molecule induces T cell-mediated tumor cell killing with an $EC_{50}$ value of less than about 1.3 nM, as measured in an in vitro T cell-mediated tumor cell killing assay, for example, where the tumor cells are C4-2, 22Rv1, and TRAMPC2_PSMA cells.

In some applications, the first antigen-binding domain binds human CD3 with an $K_D$ value of greater than about 11 nM, as measured in an in vitro surface plasmon resonance binding assay. In some instances, the first antigen-binding domain binds each of human CD3 and cynomolgus CD3 with an $K_D$ value of greater than about 15 nM, greater than about 30 nM, greater than about 60 nM, greater than about 120 nM, or greater than about 300 nM, as measured in an in vitro surface plasmon resonance binding assay.

In certain embodiments, anti-CD3 antibodies of the invention, antigen-binding fragments and bispecific antibodies thereof were made by replacing amino acid residues of a parental in a stepwise manner based on differences between the germline sequence and the parental antibody sequence.

In some embodiments, the invention provides a bispecific antigen-binding molecule, wherein the second antigen-binding domain competes for binding to human PSMA with a reference antigen-binding protein comprising three heavy chain complementarity determining regions (A2-HCDR1, A2-HCDR2 and A2-HCDR3) and three light chain complementarity determining regions (A2-LCDR1, A2-LCDR2 and A2-LCDR3), wherein A2-HCDR1 comprises an amino acid sequence selected from the group consisting of SEQ ID NOs: 124 and 68; A2-HCDR2 comprises an amino acid sequence selected from the group consisting of SEQ ID NOs: 126 and 70; A2-HCDR3 comprises an amino acid sequence selected from the group consisting of SEQ ID NOs: 128 and 72; A2-LCDR1 comprises an amino acid sequence selected from the group consisting of SEQ ID NOs: 164, 932 and 1644; A2-LCDR2 comprises an amino acid sequence selected from the group consisting of SEQ ID NOs: 166, 934 and 1646; and A2-LCDR3 comprises an amino acid sequence selected from the group consisting of SEQ ID NOs:168, 936, and 1648. In some embodiments, the invention provides a bispecific antigen-binding molecule, wherein the second antigen-binding domain competes for binding to human PSMA with a reference antigen-binding protein comprising a heavy chain variable region (HCVR) comprising an amino acid sequence selected from the group consisting of SEQ ID NOs: 122 and 66, and a light chain variable region (LCVR) comprising an amino acid sequence selected from the group consisting of SEQ ID NOs: 162, 930 and 1642.

In some embodiments, the invention provides a bispecific antigen-binding molecule, wherein the first antigen-binding domain competes for binding to human CD3 with a reference antigen-binding protein comprising three heavy chain complementarity determining regions (A1-HCDR1, A1-HCDR2 and A1-HCDR3) and three light chain complementarity determining regions (A1-LCDR1, A1-LCDR2 and A1-LCDR3), wherein A1-HCDR1 comprises an amino acid sequence selected from the group consisting of SEQ ID NOs: 924, 156, 1484, 1492, 1500, 1508, 1516, 1524, 1532, 1540, 1548, 1556, 1564, 1572, 1580, 1588, 1596, 1604, 1612, 1620, and 1628; A1-HCDR2 comprises an amino acid sequence selected from the group consisting of SEQ ID NOs: 926, 158, 1486, 1494, 1502, 1510, 1518, 1526, 1534, 1542, 1550, 1558, 1566, 1574, 1582, 1590, 1598, 1606, 1614, 1622, and 1630; A1-HCDR3 comprises an amino acid sequence selected from the group consisting of SEQ ID NOs: 928, 160, 1488, 1496, 1504, 1512, 1520, 1528, 1536, 1544, 1552, 1560, 1568, 1576, 1584, 1592, 1600, 1608, 1616, 1624, and 1632; A1-LCDR1 comprises an amino acid sequence selected from the group consisting of SEQ ID NOs: 164, 932, and 1644; A1-LCDR2 comprises an amino acid sequence selected from the group consisting of SEQ ID NOs: 166, 934, and 1646; and A1-LCDR3 comprises an amino acid sequence selected from the group consisting of SEQ ID NOs: 168, 936, and 1648. In some embodiments, the invention provides a bispecific antigen-binding molecule, wherein the first antigen-binding domain competes for binding to human CD3 with a reference antigen-binding protein comprising a heavy chain variable region (HCVR) comprising an amino acid sequence selected from the group consisting of SEQ ID NOs: 922, 154, 1482, 1490, 1498, 1506, 1514, 1522, 1530, 1538, 1546, 1554, 1562, 1570, 1578, 1586, 1594, 1602, 1610, 1618, and 1626, and a light chain variable region (LCVR) comprising an amino acid sequence selected from the group consisting of SEQ ID NOs:930, 162, and 1642.

In some embodiments, the invention provides a bispecific antigen-binding molecule, wherein the first antigen-binding domain competes for binding to human CD3 with a reference antigen-binding protein comprising a heavy chain variable region (HCVR) comprising an amino acid sequence selected from the group consisting of SEQ ID NOs: 922, 154, 1482, 1490, 1498, 1506, 1514, 1522, 1530, 1538, 1546, 1554, 1562, 1570, 1578, 1586, 1594, 1602, 1610, 1618, and 1626, and a light chain variable region (LCVR) comprising an amino acid sequence selected from the group consisting of SEQ ID NOs:930, 162, and 1642; and wherein the second antigen-binding domain competes for binding to human PSMA with a reference antigen-binding protein comprising a heavy chain variable region (HCVR) comprising an amino acid sequence selected from the group consisting of SEQ ID NOs:122 and 66, and a light chain variable region (LCVR) comprising an amino acid sequence selected from the group consisting of SEQ ID NOs: 930, 162, and 1642.

In one aspect, the invention provides a pharmaceutical composition comprising an anti-PSMA antigen-binding molecule or anti-PSMA/anti-CD3 bispecific antigen-binding molecule and a pharmaceutically acceptable carrier or diluent. The invention further provides a method for treating a cancer in a subject, the method comprising administering to the subject the pharmaceutical composition comprising an anti-PSMA antigen-binding molecule or anti-PSMA/anti-CD3 bispecific antigen-binding molecule and a pharmaceutically acceptable carrier or diluent. In some embodiments, the cancer is selected from the group consisting of prostate cancer, kidney cancer, bladder cancer, colorectal cancer, and gastric cancer. In some cases, the cancer is prostate cancer. In some cases, the prostate cancer is castrate-resistant prostate cancer.

In another aspect, the present invention provides nucleic acid molecules encoding any of the HCVR, LCVR or CDR sequences of the anti-CD3/anti-PSMA bispecific antigen-binding molecules disclosed herein, including nucleic acid molecules comprising the polynucleotide sequences as set forth in Tables 2, 13, 15, 17, 19, and 21 herein, as well as nucleic acid molecules comprising two or more of the polynucleotide sequences as set forth in Tables 2, 13, 15, 17, 19, and 21 in any functional combination or arrangement thereof. Recombinant expression vectors carrying the nucleic acids of the invention, and host cells into which such vectors have been introduced, are also encompassed by the invention, as are methods of producing the antibodies by culturing the host cells under conditions permitting production of the antibodies, and recovering the antibodies produced.

The present invention includes anti-CD3/anti-PSMA bispecific antigen-binding molecules wherein any of the aforementioned antigen-binding domains that specifically bind CD3 are combined, connected or otherwise associated with any of the aforementioned antigen-binding domains that specifically bind PSMA to form a bispecific antigen-binding molecule that binds CD3 and PSMA.

The present invention includes anti-CD3/anti-PSMA bispecific antigen-binding molecules having a modified glycosylation pattern. In some applications, modification to remove undesirable glycosylation sites may be useful, or an antibody lacking a fucose moiety present on the oligosaccharide chain, for example, to increase antibody dependent cellular cytotoxicity (ADCC) function (see Shield et al. (2002) JBC 277:26733). In other applications, modification of galactosylation can be made in order to modify complement dependent cytotoxicity (CDC).

In another aspect, the invention provides a pharmaceutical composition comprising an anti-CD3/anti-PSMA bispecific antigen-binding molecule as disclosed herein and a pharmaceutically acceptable carrier. In a related aspect, the invention features a composition which is a combination of an anti-CD3/anti-PSMA bispecific antigen-binding molecule and a second therapeutic agent. In one embodiment, the second therapeutic agent is any agent that is advantageously combined with an anti-CD3/anti-PSMA bispecific antigen-binding molecule. Exemplary agents that may be advantageously combined with an anti-CD3/anti-PSMA bispecific antigen-binding molecule are discussed in detail elsewhere herein.

In yet another aspect, the invention provides therapeutic methods for targeting/killing tumor cells expressing PSMA using an anti-CD3/anti-PSMA bispecific antigen-binding molecule of the invention, wherein the therapeutic methods comprise administering a therapeutically effective amount of a pharmaceutical composition comprising an anti-CD3/anti-PSMA bispecific antigen-binding molecule of the invention to a subject in need thereof.

The present invention also includes the use of an anti-CD3/anti-PSMA bispecific antigen-binding molecule of the invention in the manufacture of a medicament for the treatment of a disease or disorder related to or caused by PSMA-expressing cells.

Other embodiments will become apparent from a review of the ensuing detailed description.

DETAILED DESCRIPTION

Figure 1:
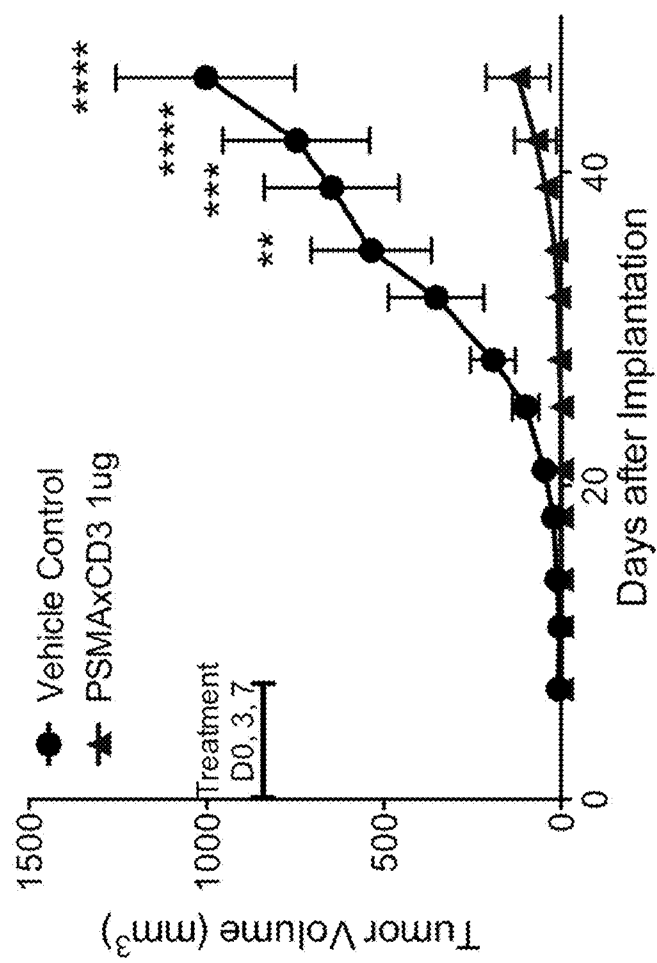
FIG. 1 illustrates that PSMA×CD3 bispecific antibody inhibits growth of a human prostate cell line in vivo. NSG mice were co-implanted with 22Rv1 cells and human PBMCs subcutaneously. The animals were dosed three times total on Days 0, 3 and 7 with 1 ug of PSMA×CD3 bispecific i.p. Data are expressed as mean (SEM) and were analyzed using analysis of variance (ANOVA).
Figures 2A, 2B:
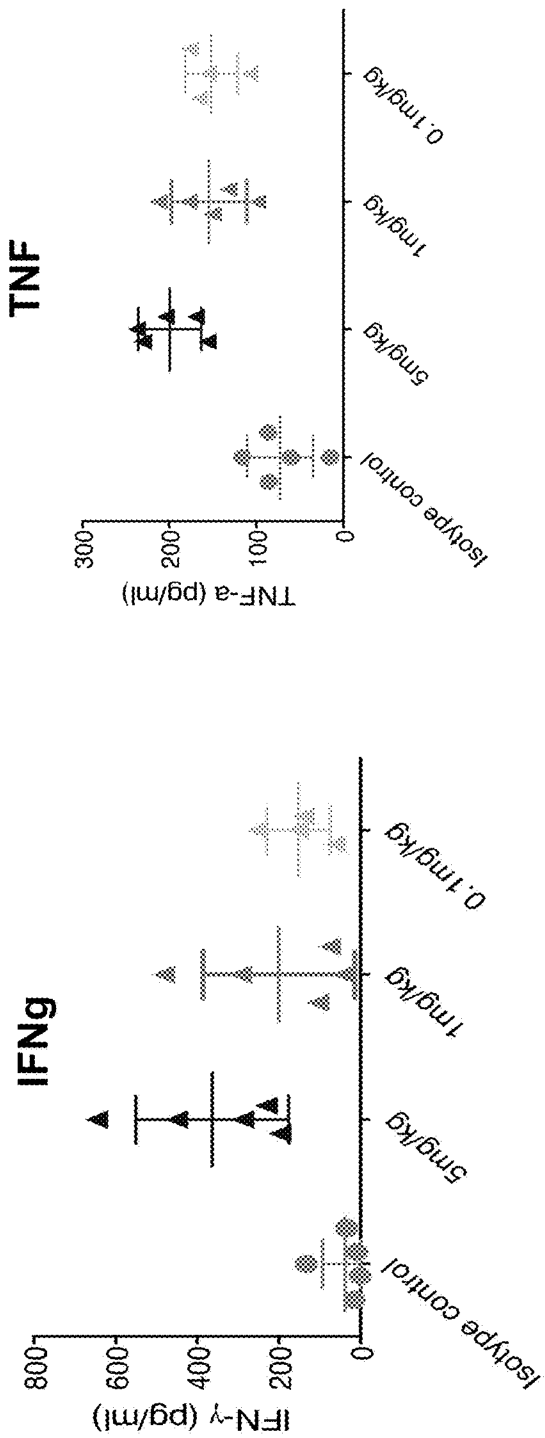
FIGS. 2A-2D show that treatment with a PSMA×CD3 bispecific antibody induces transient dose-dependent increase in circulating cytokines, where the cytokine levels (interferon-gamma, IFN-g; tumor necrosis factor, TNF; interleukin-2, IL-2; and interleukin-6, IL-6) are tested at 4 hrs after treatment.
Figures 2C, 2D:
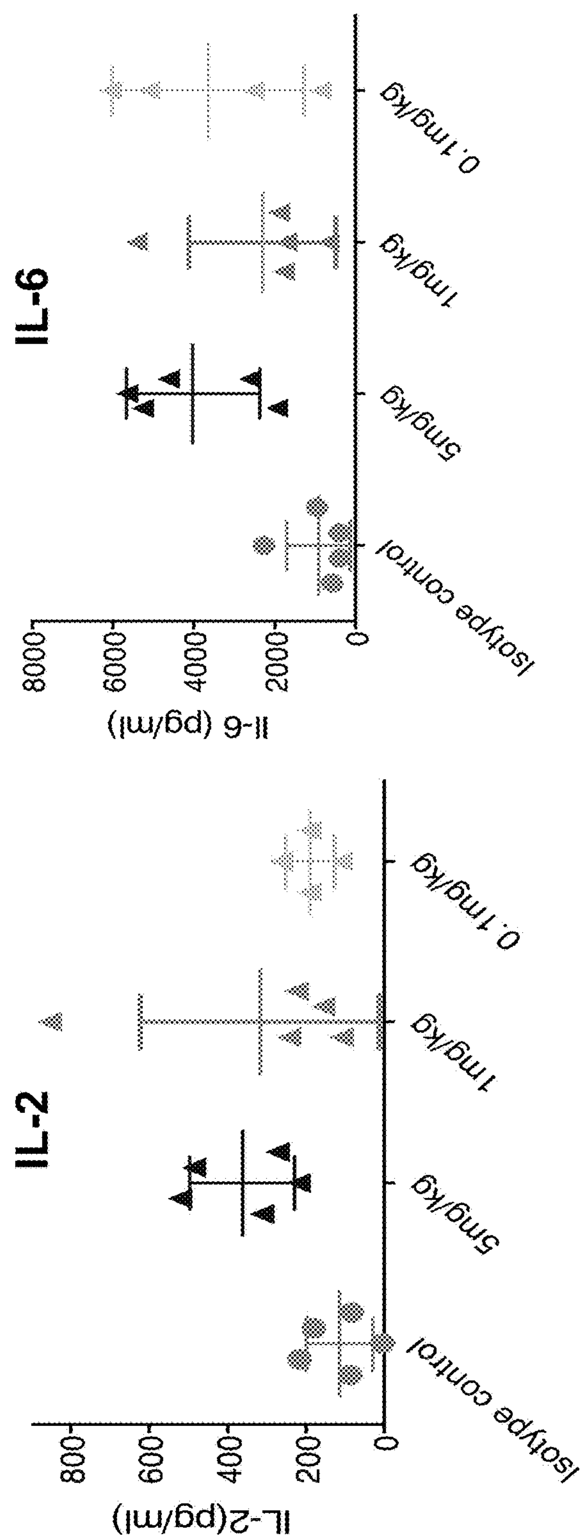

Before the present invention is described, it is to be understood that this invention is not limited to particular methods and experimental conditions described, as such methods and conditions may vary. It is also to be understood that the terminology used herein is for the purpose of describing particular embodiments only, and is not intended to be limiting, since the scope of the present invention will be limited only by the appended claims.

Unless defined otherwise, all technical and scientific terms used herein have the same meaning as commonly understood by one of ordinary skill in the art to which this invention belongs. As used herein, the term "about," when used in reference to a particular recited numerical value, means that the value may vary from the recited value by no more than 1%. For example, as used herein, the expression "about 100" includes 99 and 101 and all values in between (e.g., 99.1, 99.2, 99.3, 99.4, etc.).

Although any methods and materials similar or equivalent to those described herein can be used in the practice or testing of the present invention, the preferred methods and materials are now described. All patents, applications and non-patent publications mentioned in this specification are incorporated herein by reference in their entireties.

Definitions

The expression "CD3," as used herein, refers to an antigen which is expressed on T cells as part of the multi-molecular T cell receptor (TCR) and which consists of a homodimer or heterodimer formed from the association of two of four receptor chains: CD3-epsilon, CD3-delta, CD3-zeta, and CD3-gamma. Human CD3-epsilon comprises the amino acid sequence as set forth in SEQ ID NO:1649; human CD3-delta comprises the amino acid sequence as set forth in SEQ ID NO:1650. All references to proteins, polypeptides and protein fragments herein are intended to refer to the human version of the respective protein, polypeptide or protein fragment unless explicitly specified as being from a non-human species. Thus, the expression "CD3" means human CD3 unless specified as being from a non-human species, e.g., "mouse CD3," "monkey CD3," etc.

As used herein, "an antibody that binds CD3" or an "anti-CD3 antibody" includes antibodies and antigen-binding fragments thereof that specifically recognize a single CD3 subunit (e.g., epsilon, delta, gamma or zeta), as well as antibodies and antigen-binding fragments thereof that specifically recognize a dimeric complex of two CD3 subunits (e.g., gamma/epsilon, delta/epsilon, and zeta/zeta CD3 dimers). The antibodies and antigen-binding fragments of the present invention may bind soluble CD3 and/or cell surface expressed CD3. Soluble CD3 includes natural CD3 proteins as well as recombinant CD3 protein variants such as, e.g., monomeric and dimeric CD3 constructs, that lack a transmembrane domain or are otherwise unassociated with a cell membrane.

As used herein, the expression "cell surface-expressed CD3" means one or more CD3 protein(s) that is/are expressed on the surface of a cell in vitro or in vivo, such that at least a portion of a CD3 protein is exposed to the extracellular side of the cell membrane and is accessible to an antigen-binding portion of an antibody. "Cell surface-expressed CD3" includes CD3 proteins contained within the context of a functional T cell receptor in the membrane of a cell. The expression "cell surface-expressed CD3" includes CD3 protein expressed as part of a homodimer or heterodimer on the surface of a cell (e.g., gamma/epsilon, delta/epsilon, and zeta/zeta CD3 dimers). The expression, "cell surface-expressed CD3" also includes a CD3 chain (e.g., CD3-epsilon, CD3-delta or CD3-gamma) that is expressed by itself, without other CD3 chain types, on the surface of a cell. A "cell surface-expressed CD3" can comprise or consist of a CD3 protein expressed on the surface of a cell which normally expresses CD3 protein. Alternatively, "cell surface-expressed CD3" can comprise or consist of CD3 protein expressed on the surface of a cell that normally does not express human CD3 on its surface but has been artificially engineered to express CD3 on its surface.

The expression "PSMA," as used herein, refers to prostate-specific membrane antigen, also known as folate hydrolase 1 (FOLH1). PSMA is an integral, non-shed membrane glycoprotein that is highly expressed in prostate epithelial cells and is a cell-surface marker for prostate cancer. The amino acid sequence of human PSMA is set forth in SEQ ID NO:1651.

As used herein, "an antibody that binds PSMA" or an "anti-PSMA antibody" includes antibodies and antigen-binding fragments thereof that specifically recognize PSMA.

The term "antigen-binding molecule" includes antibodies and antigen-binding fragments of antibodies, including, e.g., bispecific antibodies.

The term "antibody", as used herein, means any antigen-binding molecule or molecular complex comprising at least one complementarity determining region (CDR) that specifically binds to or interacts with a particular antigen (e.g., PSMA or CD3). The term "antibody" includes immunoglobulin molecules comprising four polypeptide chains, two heavy (H) chains and two light (L) chains inter-connected by disulfide bonds, as well as multimers thereof (e.g., IgM). Each heavy chain comprises a heavy chain variable region (abbreviated herein as HCVR or $V_H$) and a heavy chain constant region. The heavy chain constant region comprises three domains, $C_H1$, $C_H2$ and $C_H3$. Each light chain comprises a light chain variable region (abbreviated herein as LCVR or $V_L$) and a light chain constant region. The light chain constant region comprises one domain ($C_L1$). The $V_H$ and $V_L$ regions can be further subdivided into regions of hypervariability, termed complementarity determining regions (CDRs), interspersed with regions that are more conserved, termed framework regions (FR). Each $V_H$ and $V_L$ is composed of three CDRs and four FRs, arranged from amino-terminus to carboxy-terminus in the following order: FR1, CDR1, FR2, CDR2, FR3, CDR3, FR4. In different embodiments of the invention, the FRs of the anti-PSMA antibody or anti-CD3 antibody (or antigen-binding portion thereof) may be identical to the human germline sequences, or may be naturally or artificially modified. An amino acid consensus sequence may be defined based on a side-by-side analysis of two or more CDRs.

The term "antibody", as used herein, also includes antigen-binding fragments of full antibody molecules. The terms "antigen-binding portion" of an antibody, "antigen-binding fragment" of an antibody, and the like, as used herein, include any naturally occurring, enzymatically obtainable, synthetic, or genetically engineered polypeptide or glycoprotein that specifically binds an antigen to form a complex. Antigen-binding fragments of an antibody may be derived, e.g., from full antibody molecules using any suitable standard techniques such as proteolytic digestion or recombinant genetic engineering techniques involving the manipulation and expression of DNA encoding antibody variable and optionally constant domains. Such DNA is known and/or is readily available from, e.g., commercial sources, DNA libraries (including, e.g., phage-antibody libraries), or can be synthesized. The DNA may be sequenced and manipulated chemically or by using molecular biology techniques, for example, to arrange one or more variable and/or constant domains into a suitable configuration, or to introduce codons, create cysteine residues, modify, add or delete amino acids, etc.

Non-limiting examples of antigen-binding fragments include: (i) Fab fragments; (ii) F(ab')2 fragments; (iii) Fd fragments; (iv) Fv fragments; (v) single-chain Fv (scFv) molecules; (vi) dAb fragments; and (vii) minimal recognition units consisting of the amino acid residues that mimic the hypervariable region of an antibody (e.g., an isolated complementarity determining region (CDR) such as a CDR3 peptide), or a constrained FR3-CDR3-FR4 peptide. Other engineered molecules, such as domain-specific antibodies, single domain antibodies, domain-deleted antibodies, chimeric antibodies, CDR-grafted antibodies, diabodies, triabodies, tetrabodies, minibodies, nanobodies (e.g. monovalent nanobodies, bivalent nanobodies, etc.), small modular immunopharmaceuticals (SMIPs), and shark variable IgNAR domains, are also encompassed within the expression "antigen-binding fragment," as used herein.

An antigen-binding fragment of an antibody will typically comprise at least one variable domain. The variable domain may be of any size or amino acid composition and will generally comprise at least one CDR which is adjacent to or in frame with one or more framework sequences. In antigen-binding fragments having a $V_H$ domain associated with a $V_L$ domain, the $V_H$ and $V_L$ domains may be situated relative to one another in any suitable arrangement. For example, the variable region may be dimeric and contain $V_H$-$V_H$, $V_H$-$V_L$ or $V_L$-$V_L$ dimers. Alternatively, the antigen-binding fragment of an antibody may contain a monomeric $V_H$ or $V_L$ domain.

In certain embodiments, an antigen-binding fragment of an antibody may contain at least one variable domain covalently linked to at least one constant domain. Non-limiting, exemplary configurations of variable and constant domains that may be found within an antigen-binding fragment of an antibody of the present invention include: (i) $V_H$-$C_H1$; (ii) $V_H$-$C_H2$; (iii) $V_H$-$C_H3$; (iv) $V_H$-$C_H1$-$C_H2$; (v) $V_H$-$C_H1$-$C_H2$-$C_H3$; (vi) $V_H$-$C_H2$-$C_H3$; (vii) $V_H$-$C_L$; (viii) $V_L$-$C_H1$; (ix) $V_L$-$C_H2$; (x) $V_L$-$C_H3$; (xi) $V_L$-$C_H1$-$C_H2$; (xii) $V_L$-$C_H1$-$C_H2$-$C_H3$; (xiii) $V_L$-$C_H2$-$C_H3$; and (xiv) $V_L$-$C_L$. In any configuration of variable and constant domains, including any of the exemplary configurations listed above, the variable and constant domains may be either directly linked to one another or may be linked by a full or partial hinge or linker region. A hinge region may consist of at least 2 (e.g., 5, 10, 15, 20, 40, 60 or more) amino acids which result in a flexible or semi-flexible linkage between adjacent variable and/or constant domains in a single polypeptide molecule. Moreover, an antigen-binding fragment of an antibody of the present invention may comprise a homo-dimer or hetero-dimer (or other multimer) of any of the variable and constant domain configurations listed above in non-covalent association with one another and/or with one or more monomeric $V_H$ or $V_L$ domain (e.g., by disulfide bond(s)).

As with full antibody molecules, antigen-binding fragments may be monospecific or multispecific (e.g., bispecific). A multispecific antigen-binding fragment of an antibody will typically comprise at least two different variable domains, wherein each variable domain is capable of specifically binding to a separate antigen or to a different epitope on the same antigen. Any multispecific antibody format, including the exemplary bispecific antibody formats disclosed herein, may be adapted for use in the context of an antigen-binding fragment of an antibody of the present invention using routine techniques available in the art.

The antibodies of the present invention may function through complement-dependent cytotoxicity (CDC) or antibody-dependent cell-mediated cytotoxicity (ADCC). "Complement-dependent cytotoxicity" (CDC) refers to lysis of antigen-expressing cells by an antibody of the invention in the presence of complement. "Antibody-dependent cell-mediated cytotoxicity" (ADCC) refers to a cell-mediated reaction in which nonspecific cytotoxic cells that express Fc receptors (FcRs) (e.g., Natural Killer (NK) cells, neutrophils, and macrophages) recognize bound antibody on a target cell and thereby lead to lysis of the target cell. CDC and ADCC can be measured using assays that are well known and available in the art. (See, e.g., U.S. Pat. Nos. 5,500,362 and 5,821,337, and Clynes et al. (1998) Proc. Natl. Acad. Sci. (USA) 95:652-656). The constant region of an antibody is important in the ability of an antibody to fix complement and mediate cell-dependent cytotoxicity. Thus, the isotype of an antibody may be selected on the basis of whether it is desirable for the antibody to mediate cytotoxicity.

In certain embodiments of the invention, the anti-PSMA monospecific antibodies or anti-PSMA/anti-CD3 bispecific antibodies of the invention are human antibodies. The term "human antibody", as used herein, is intended to include antibodies having variable and constant regions derived from human germline immunoglobulin sequences. The human antibodies of the invention may include amino acid residues not encoded by human germline immunoglobulin sequences (e.g., mutations introduced by random or site-specific mutagenesis in vitro or by somatic mutation in vivo), for example in the CDRs and in particular CDR3. However, the term "human antibody", as used herein, is not intended to include antibodies in which CDR sequences derived from the germline of another mammalian species, such as a mouse, have been grafted onto human framework sequences.

The antibodies of the invention may, in some embodiments, be recombinant human antibodies. The term "recombinant human antibody", as used herein, is intended to include all human antibodies that are prepared, expressed, created or isolated by recombinant means, such as antibodies expressed using a recombinant expression vector transfected into a host cell (described further below), antibodies isolated from a recombinant, combinatorial human antibody library (described further below), antibodies isolated from an animal (e.g., a mouse) that is transgenic for human immunoglobulin genes (see e.g., Taylor et al. (1992) Nucl. Acids Res. 20:6287-6295) or antibodies prepared, expressed, created or isolated by any other means that involves splicing of human immunoglobulin gene sequences to other DNA sequences. Such recombinant human antibodies have variable and constant regions derived from human germline immunoglobulin sequences. In certain embodiments, however, such recombinant human antibodies are subjected to in vitro mutagenesis (or, when an animal transgenic for human Ig sequences is used, in vivo somatic mutagenesis) and thus the amino acid sequences of the $V_H$ and $V_L$ regions of the recombinant antibodies are sequences that, while derived from and related to human germline $V_H$ and $V_L$ sequences, may not naturally exist within the human antibody germline repertoire in vivo.

Human antibodies can exist in two forms that are associated with hinge heterogeneity. In one form, an immunoglobulin molecule comprises a stable four chain construct of approximately 150-160 kDa in which the dimers are held together by an interchain heavy chain disulfide bond. In a second form, the dimers are not linked via inter-chain disulfide bonds and a molecule of about 75-80 kDa is formed composed of a covalently coupled light and heavy chain (half-antibody). These forms have been extremely difficult to separate, even after affinity purification.

The frequency of appearance of the second form in various intact IgG isotypes is due to, but not limited to, structural differences associated with the hinge region isotype of the antibody. A single amino acid substitution in the hinge region of the human IgG4 hinge can significantly reduce the appearance of the second form (Angal et al. (1993) Molecular Immunology 30:105) to levels typically observed using a human IgG1 hinge. The instant invention encompasses antibodies having one or more mutations in the hinge, $C_H2$ or $C_H3$ region which may be desirable, for example, in production, to improve the yield of the desired antibody form.

The antibodies of the invention may be isolated antibodies. An "isolated antibody," as used herein, means an antibody that has been identified and separated and/or recovered from at least one component of its natural environment. For example, an antibody that has been separated or removed from at least one component of an organism, or from a tissue or cell in which the antibody naturally exists or is naturally produced, is an "isolated antibody" for purposes of the present invention. An isolated antibody also includes an antibody in situ within a recombinant cell. Isolated antibodies are antibodies that have been subjected to at least one purification or isolation step. According to certain embodiments, an isolated antibody may be substantially free of other cellular material and/or chemicals.

The present invention also includes one-arm antibodies that bind PSMA. As used herein, a "one-arm antibody" means an antigen-binding molecule comprising a single antibody heavy chain and a single antibody light chain. The one-arm antibodies of the present invention may comprise any of the HCVR/LCVR or CDR amino acid sequences as set forth in Table 1.

The anti-PSMA or anti-PSMA/anti-CD3 antibodies disclosed herein may comprise one or more amino acid substitutions, insertions and/or deletions in the framework and/or CDR regions of the heavy and light chain variable domains as compared to the corresponding germline sequences from which the antibodies were derived. Such mutations can be readily ascertained by comparing the amino acid sequences disclosed herein to germline sequences available from, for example, public antibody sequence databases. The present invention includes antibodies, and antigen-binding fragments thereof, which are derived from any of the amino acid sequences disclosed herein, wherein one or more amino acids within one or more framework and/or CDR regions are mutated to the corresponding residue(s) of the germline sequence from which the antibody was derived, or to the corresponding residue(s) of another human germline sequence, or to a conservative amino acid substitution of the corresponding germline residue(s) (such sequence changes are referred to herein collectively as "germline mutations"). A person of ordinary skill in the art, starting with the heavy and light chain variable region sequences disclosed herein, can easily produce numerous antibodies and antigen-binding fragments which comprise one or more individual germline mutations or combinations thereof. In certain embodiments, all of the framework and/or CDR residues within the $V_H$ and/or $V_L$ domains are mutated back to the residues found in the original germline sequence from which the antibody was derived. In other embodiments, only certain residues are mutated back to the original germline sequence, e.g., only the mutated residues found within the first 8 amino acids of FR1 or within the last 8 amino acids of FR4, or only the mutated residues found within CDR1, CDR2 or CDR3. In other embodiments, one or more of the framework and/or CDR residue(s) are mutated to the corresponding residue(s) of a different germline sequence (i.e., a germline sequence that is different from the germline sequence from which the antibody was originally derived). Furthermore, the antibodies of the present invention may contain any combination of two or more germline mutations within the framework and/or CDR regions, e.g., wherein certain individual residues are mutated to the corresponding residue of a particular germline sequence while certain other residues that differ from the original germline sequence are maintained or are mutated to the corresponding residue of a different germline sequence. Once obtained, antibodies and antigen-binding fragments that contain one or more germline mutations can be easily tested for one or more desired property such as, improved binding specificity, increased binding affinity, improved or enhanced antagonistic or agonistic biological properties (as the case may be), reduced immunogenicity, etc. Antibodies and antigen-binding fragments obtained in this general manner are encompassed within the present invention.

The present invention also includes anti-PSMA or anti-PSMA/anti-CD3 antibodies comprising variants of any of the HCVR, LCVR, and/or CDR amino acid sequences disclosed herein having one or more conservative substitutions. For example, the present invention includes anti-PSMA or anti-PSMA/anti-CD3 antibodies having HCVR, LCVR, and/or CDR amino acid sequences with, e.g., 10 or fewer, 8 or fewer, 6 or fewer, 4 or fewer, etc. conservative amino acid substitutions relative to any of the HCVR, LCVR, and/or CDR amino acid sequences set forth in Table 1 herein or as described in Tables 12, 14, 15, 18, and 20 herein.

The term "epitope" refers to an antigenic determinant that interacts with a specific antigen binding site in the variable region of an antibody molecule known as a paratope. A single antigen may have more than one epitope. Thus, different antibodies may bind to different areas on an antigen and may have different biological effects. Epitopes may be either conformational or linear. A conformational epitope is produced by spatially juxtaposed amino acids from different segments of the linear polypeptide chain. A linear epitope is one produced by adjacent amino acid residues in a polypeptide chain. In certain circumstance, an epitope may include moieties of saccharides, phosphoryl groups, or sulfonyl groups on the antigen.

The term "substantial identity" or "substantially identical," when referring to a nucleic acid or fragment thereof, indicates that, when optimally aligned with appropriate nucleotide insertions or deletions with another nucleic acid (or its complementary strand), there is nucleotide sequence identity in at least about 95%, and more preferably at least about 96%, 97%, 98% or 99% of the nucleotide bases, as measured by any well-known algorithm of sequence identity, such as FASTA, BLAST or Gap, as discussed below. A nucleic acid molecule having substantial identity to a reference nucleic acid molecule may, in certain instances, encode a polypeptide having the same or substantially similar amino acid sequence as the polypeptide encoded by the reference nucleic acid molecule.

As applied to polypeptides, the term "substantial similarity" or "substantially similar" means that two peptide sequences, when optimally aligned, such as by the programs GAP or BESTFIT using default gap weights, share at least 95% sequence identity, even more preferably at least 98% or 99% sequence identity. Preferably, residue positions which are not identical differ by conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. In cases where two or more amino acid sequences differ from each other by conservative substitutions, the percent sequence identity or degree of similarity may be adjusted upwards to correct for the conservative nature of the substitution. Means for making this adjustment are well-known to those of skill in the art. See, e.g., Pearson (1994) Methods Mol. Biol. 24: 307-331, herein incorporated by reference. Examples of groups of amino acids that have side chains with similar chemical properties include (1) aliphatic side chains: glycine, alanine, valine, leucine and isoleucine; (2) aliphatic-hydroxyl side chains: serine and threonine; (3) amide-containing side chains: asparagine and glutamine; (4) aromatic side chains: phenylalanine, tyrosine, and tryptophan; (5) basic side chains: lysine, arginine, and histidine; (6) acidic side chains: aspartate and glutamate, and (7) sulfur-containing side chains are cysteine and methionine. Preferred conservative amino acids substitution groups are: valine-leucine-isoleucine, phenylalanine-tyrosine, lysine-arginine, alanine-valine, glutamate-aspartate, and asparagine-glutamine. Alternatively, a conservative replacement is any change having a positive value in the PAM250 log-likelihood matrix disclosed in Gonnet et al. (1992) Science 256: 1443-1445, herein incorporated by reference. A "moderately conservative" replacement is any change having a nonnegative value in the PAM250 log-likelihood matrix.

Sequence similarity for polypeptides, which is also referred to as sequence identity, is typically measured using sequence analysis software. Protein analysis software matches similar sequences using measures of similarity assigned to various substitutions, deletions and other modifications, including conservative amino acid substitutions. For instance, GCG software contains programs such as Gap and Bestfit which can be used with default parameters to determine sequence homology or sequence identity between closely related polypeptides, such as homologous polypeptides from different species of organisms or between a wild type protein and a mutein thereof. See, e.g., GCG Version 6.1. Polypeptide sequences also can be compared using FASTA using default or recommended parameters, a program in GCG Version 6.1. FASTA (e.g., FASTA2 and FASTA3) provides alignments and percent sequence identity of the regions of the best overlap between the query and search sequences (Pearson (2000) supra). Another preferred algorithm when comparing a sequence of the invention to a database containing a large number of sequences from different organisms is the computer program BLAST, especially BLASTP or TBLASTN, using default parameters. See, e.g., Altschul et al. (1990) J. Mol. Biol. 215:403-410 and Altschul et al. (1997) Nucleic Acids Res. 25:3389-402, each herein incorporated by reference.

Germline Mutations

The anti-CD3 antibodies disclosed herein comprise one or more amino acid substitutions, insertions and/or deletions in the framework and/or CDR regions of the heavy chain variable domains as compared to the corresponding germline sequences from which the antibodies were derived.

The present invention also includes antibodies, and antigen-binding fragments thereof, which are derived from any of the amino acid sequences disclosed herein, wherein one or more amino acids within one or more framework and/or CDR regions are mutated to the corresponding residue(s) of the germline sequence from which the antibody was derived, or to the corresponding residue(s) of another human germline sequence, or to a conservative amino acid substitution of the corresponding germline residue(s) (such sequence changes are referred to herein collectively as "germline mutations"), and having weak or no detectable binding to a CD3 antigen. Several such exemplary antibodies that recognize CD3 are described in Tables 12 and 18 herein.

Furthermore, the antibodies of the present invention may contain any combination of two or more germline mutations within the framework and/or CDR regions, e.g., wherein certain individual residues are mutated to the corresponding residue of a particular germline sequence while certain other residues that differ from the original germline sequence are maintained or are mutated to the corresponding residue of a different germline sequence. Once obtained, antibodies and antigen-binding fragments that contain one or more germline mutations can be tested for one or more desired properties such as, improved binding specificity, weak or reduced binding affinity, improved or enhanced pharmacokinetic properties, reduced immunogenicity, etc. Antibodies and antigen-binding fragments obtained in this general manner given the guidance of the present disclosure are encompassed within the present invention.

The present invention also includes anti-CD3 antibodies comprising variants of any of the HCVR, LCVR, and/or CDR amino acid sequences disclosed herein having one or more conservative substitutions. For example, the present invention includes anti-CD3 antibodies having HCVR, LCVR, and/or CDR amino acid sequences with, e.g., 10 or fewer, 8 or fewer, 6 or fewer, 4 or fewer, etc. conservative amino acid substitutions relative to any of the HCVR, LCVR, and/or CDR amino acid sequences set forth in Tables 12, 14, 15, 18, and 20 herein. The antibodies and bispecific antigen-binding molecules of the present invention comprise one or more amino acid substitutions, insertions and/or deletions in the framework and/or CDR regions of the heavy and light chain variable domains as compared to the corresponding germline sequences from which the individual antigen-binding domains were derived, while maintaining or improving the desired weak-to-no detectable binding to CD3 antigen. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein, i.e. the amino acid substitution maintains or improves the desired weak to no detectable binding affinity in the case of anti-CD3 binding molecules. Examples of groups of amino acids that have side chains with similar chemical properties include (1) aliphatic side chains: glycine, alanine, valine, leucine and isoleucine; (2) aliphatic-hydroxyl side chains: serine and threonine; (3) amide-containing side chains: asparagine and glutamine; (4) aromatic side chains: phenylalanine, tyrosine, and tryptophan; (5) basic side chains: lysine, arginine, and histidine; (6) acidic side chains: aspartate and glutamate, and (7) sulfur-containing side chains are cysteine and methionine. Preferred conservative amino acids substitution groups are: valine-leucine-isoleucine, phenylalanine-tyrosine, lysine-arginine, alanine-valine, glutamate-aspartate, and asparagine-glutamine. Alternatively, a conservative replacement is any change having a positive value in the PAM250 log-likelihood matrix disclosed in Gonnet et al. (1992) Science 256: 1443-1445. A "moderately conservative" replacement is any change having a nonnegative value in the PAM250 log-likelihood matrix.

The present invention also includes antigen-binding molecules comprising an antigen-binding domain with an HCVR and/or CDR amino acid sequence that is substantially identical to any of the HCVR and/or CDR amino acid sequences disclosed herein, while maintaining or improving the desired weak affinity to CD3 antigen. The term "substantial identity" or "substantially identical," when referring to an amino acid sequence means that two amino acid sequences, when optimally aligned, such as by the programs GAP or BESTFIT using default gap weights, share at least 95% sequence identity, even more preferably at least 98% or 99% sequence identity. Preferably, residue positions which are not identical differ by conservative amino acid substitutions. In cases where two or more amino acid sequences differ from each other by conservative substitutions, the percent sequence identity or degree of similarity may be adjusted upwards to correct for the conservative nature of the substitution. Means for making this adjustment are well-known to those of skill in the art. See, e.g., Pearson (1994) Methods Mol. Biol. 24: 307-331.

Sequence similarity for polypeptides, which is also referred to as sequence identity, is typically measured using sequence analysis software. Protein analysis software matches similar sequences using measures of similarity assigned to various substitutions, deletions and other modifications, including conservative amino acid substitutions. For instance, GCG software contains programs such as Gap and Bestfit which can be used with default parameters to determine sequence homology or sequence identity between closely related polypeptides, such as homologous polypeptides from different species of organisms or between a wild type protein and a mutein thereof. See, e.g., GCG Version 6.1. Polypeptide sequences also can be compared using FASTA using default or recommended parameters, a program in GCG Version 6.1. FASTA (e.g., FASTA2 and FASTA3) provides alignments and percent sequence identity of the regions of the best overlap between the query and search sequences (Pearson (2000) supra). Another preferred algorithm when comparing a sequence of the invention to a database containing a large number of sequences from different organisms is the computer program BLAST, especially BLASTP or TBLASTN, using default parameters. See, e.g., Altschul et al. (1990) J. Mol. Biol. 215:403-410 and Altschul et al. (1997) Nucleic Acids Res. 25:3389-402.

Once obtained, antigen-binding domains that contain one or more germline mutations were tested for decreased binding affinity utilizing one or more in vitro assays. Although antibodies that recognize a particular antigen are typically screened for their purpose by testing for high (i.e. strong) binding affinity to the antigen, the antibodies of the present invention exhibit weak binding or no detectable binding. Bispecific antigen-binding molecules comprising one or more antigen-binding domains obtained in this general manner are also encompassed within the present invention and were found to be advantageous as avidity-driven tumor therapies.

Unexpected benefits, for example, improved pharmacokinetic properties and low toxicity to the patient may be realized from the methods described herein.

Binding Properties of the Antibodies

As used herein, the term "binding" in the context of the binding of an antibody, immunoglobulin, antibody-binding fragment, or Fc-containing protein to either, e.g., a predetermined antigen, such as a cell surface protein or fragment thereof, typically refers to an interaction or association between a minimum of two entities or molecular structures, such as an antibody-antigen interaction.

For instance, binding affinity typically corresponds to a $K_D$ value of about $10^{-7}$ M or less, such as about $10^{-8}$ M or less, such as about $10^{-9}$ M or less when determined by, for instance, surface plasmon resonance (SPR) technology in a BIAcore™ 3000 instrument using the antigen as the ligand and the antibody, Ig, antibody-binding fragment, or Fc-containing protein as the analyte (or antiligand). Cell-based binding strategies, such as fluorescent-activated cell sorting (FACS) binding assays, are also routinely used, and FACS data correlates well with other methods such as radioligand competition binding and SPR (Benedict, Calif., *J Immuno Methods.* 1997, 201(2):223-31; Geuijen, Calif., et al. *J Immuno Methods.* 2005, 302(1-2):68-77).

Accordingly, the antibody or antigen-binding protein of the invention binds to the predetermined antigen or cell surface molecule (receptor) having an affinity corresponding to a $K_D$ value that is at least ten-fold lower than its affinity for binding to a non-specific antigen (e.g., BSA, casein). According to the present invention, the affinity of an antibody corresponding to a $K_D$ value that is equal to or less than ten-fold lower than a non-specific antigen may be considered non-detectable binding, however such an antibody may be paired with a second antigen binding arm for the production of a bispecific antibody of the invention.

The term "$K_D$" (M) refers to the dissociation equilibrium constant of a particular antibody-antigen interaction, or the dissociation equilibrium constant of an antibody or antibody-binding fragment binding to an antigen. There is an inverse relationship between $K_D$ and binding affinity, therefore the smaller the $K_D$ value, the higher, i.e. stronger, the affinity. Thus, the terms "higher affinity" or "stronger affinity" relate to a higher ability to form an interaction and therefore a smaller $K_D$ value, and conversely the terms "lower affinity" or "weaker affinity" relate to a lower ability to form an interaction and therefore a larger $K_D$ value. In some circumstances, a higher binding affinity (or $K_D$) of a particular molecule (e.g. antibody) to its interactive partner molecule (e.g. antigen X) compared to the binding affinity of the molecule (e.g. antibody) to another interactive partner molecule (e.g. antigen Y) may be expressed as a binding ratio determined by dividing the larger $K_D$ value (lower, or weaker, affinity) by the smaller $K_D$ (higher, or stronger, affinity), for example expressed as 5-fold or 10-fold greater binding affinity, as the case may be.

The term "$k_d$" (sec-1 or 1/s) refers to the dissociation rate constant of a particular antibody-antigen interaction, or the dissociation rate constant of an antibody or antibody-binding fragment. Said value is also referred to as the $k_{off}$ value.

The term "$k_a$" (M-1×sec-1 or 1/M) refers to the association rate constant of a particular antibody-antigen interaction, or the association rate constant of an antibody or antibody-binding fragment.

The term "$K_A$" (M-1 or 1/M) refers to the association equilibrium constant of a particular antibody-antigen interaction, or the association equilibrium constant of an antibody or antibody-binding fragment. The association equilibrium constant is obtained by dividing the $k_a$ by the $k_d$.

The term "EC50" or "$EC_{50}$" refers to the half maximal effective concentration, which includes the concentration of an antibody which induces a response halfway between the baseline and maximum after a specified exposure time. The $EC_{50}$ essentially represents the concentration of an antibody where 50% of its maximal effect is observed. In certain embodiments, the $EC_{50}$ value equals the concentration of an antibody of the invention that gives half-maximal binding to cells expressing CD3 or tumor-associated antigen, as determined by e.g. a FACS binding assay. Thus, reduced or weaker binding is observed with an increased $EC_{50}$, or half maximal effective concentration value.

In one embodiment, decreased binding can be defined as an increased $EC_{50}$ antibody concentration which enables binding to the half-maximal amount of target cells.

In another embodiment, the $EC_{50}$ value represents the concentration of an antibody of the invention that elicits half-maximal depletion of target cells by T cell cytotoxic activity. Thus, increased cytotoxic activity (e.g. T cell-mediated tumor cell killing) is observed with a decreased $EC_{50}$, or half maximal effective concentration value.

Bispecific Antigen-Binding Molecules

The antibodies of the present invention may be monospecific, bi-specific, or multispecific. Multispecific antibodies may be specific for different epitopes of one target polypeptide or may contain antigen-binding domains specific for more than one target polypeptide. See, e.g., Tutt et al., 1991, J. Immunol. 147:60-69; Kufer et al., 2004, Trends Biotechnol. 22:238-244. The anti-PSMA monospecific antibodies or anti-PSMA/anti-CD3 bispecific antibodies of the present invention can be linked to or co-expressed with another functional molecule, e.g., another peptide or protein. For example, an antibody or fragment thereof can be functionally linked (e.g., by chemical coupling, genetic fusion, noncovalent association or otherwise) to one or more other molecular entities, such as another antibody or antibody fragment to produce a bi-specific or a multispecific antibody with a second or additional binding specificity.

Use of the expression "anti-CD3 antibody" or "anti-PSMA antibody" herein is intended to include both monospecific anti-CD3 or anti-PSMA antibodies as well as bispecific antibodies comprising a CD3-binding arm and a PSMA-binding arm. Thus, the present invention includes bispecific antibodies wherein one arm of an immunoglobulin binds human CD3, and the other arm of the immunoglobulin is specific for human PSMA. The CD3-binding arm can comprise any of the HCVR/LCVR or CDR amino acid sequences as set forth in Tables 12, 14, 15, 18, and 20 herein.

In certain embodiments, the CD3-binding arm binds to human CD3 and induces human T cell activation. In certain embodiments, the CD3-binding arm binds weakly to human CD3 and induces human T cell activation. In other embodiments, the CD3-binding arm binds weakly to human CD3 and induces tumor-associated antigen-expressing cell killing in the context of a bispecific or multispecific antibody. In other embodiments, the CD3-binding arm binds or associated weakly with human and cynomolgus (monkey) CD3, yet the binding interaction is not detectable by in vitro assays known in the art. The PSMA-binding arm can comprise any of the HCVR/LCVR or CDR amino acid sequences as set forth in Table 1 herein.

According to certain exemplary embodiments, the present invention includes bispecific antigen-binding molecules that specifically bind CD3 and PSMA. Such molecules may be referred to herein as, e.g., "anti-CD3/anti-PSMA," or "anti-CD3×PSMA" or "CD3×PSMA" bispecific molecules, or other similar terminology (e.g., anti-PSMA/anti-CD3).

The term "PSMA," as used herein, refers to the human PSMA protein unless specified as being from a non-human species (e.g., "mouse PSMA," "monkey PSMA," etc.). The human PSMA protein has the amino acid sequence shown in SEQ ID NO:1651.

The aforementioned bispecific antigen-binding molecules that specifically bind CD3 and PSMA may comprise an anti-CD3 antigen-binding molecule which binds to CD3 with a weak binding affinity such as exhibiting a $K_D$ of greater than about 40 nM, as measured by an in vitro affinity binding assay.

As used herein, the expression "antigen-binding molecule" means a protein, polypeptide or molecular complex comprising or consisting of at least one complementarity determining region (CDR) that alone, or in combination with one or more additional CDRs and/or framework regions (FRs), specifically binds to a particular antigen. In certain embodiments, an antigen-binding molecule is an antibody or a fragment of an antibody, as those terms are defined elsewhere herein.

As used herein, the expression "bispecific antigen-binding molecule" means a protein, polypeptide or molecular complex comprising at least a first antigen-binding domain and a second antigen-binding domain. Each antigen-binding domain within the bispecific antigen-binding molecule comprises at least one CDR that alone, or in combination with one or more additional CDRs and/or FRs, specifically binds to a particular antigen. In the context of the present invention, the first antigen-binding domain specifically binds a first antigen (e.g., CD3), and the second antigen-binding domain specifically binds a second, distinct antigen (e.g., PSMA).

In certain exemplary embodiments of the present invention, the bispecific antigen-binding molecule is a bispecific antibody. Each antigen-binding domain of a bispecific antibody comprises a heavy chain variable domain (HCVR) and a light chain variable domain (LCVR). In the context of a bispecific antigen-binding molecule comprising a first and a second antigen-binding domain (e.g., a bispecific antibody), the CDRs of the first antigen-binding domain may be designated with the prefix "A1" and the CDRs of the second antigen-binding domain may be designated with the prefix "A2". Thus, the CDRs of the first antigen-binding domain may be referred to herein as A1-HCDR1, A1-HCDR2, and A1-HCDR3; and the CDRs of the second antigen-binding domain may be referred to herein as A2-HCDR1, A2-HCDR2, and A2-HCDR3.

The first antigen-binding domain and the second antigen-binding domain may be directly or indirectly connected to one another to form a bispecific antigen-binding molecule of the present invention. Alternatively, the first antigen-binding domain and the second antigen-binding domain may each be connected to a separate multimerizing domain. The association of one multimerizing domain with another multimerizing domain facilitates the association between the two antigen-binding domains, thereby forming a bispecific antigen-binding molecule. As used herein, a "multimerizing domain" is any macromolecule, protein, polypeptide, peptide, or amino acid that has the ability to associate with a second multimerizing domain of the same or similar structure or constitution. For example, a multimerizing domain may be a polypeptide comprising an immunoglobulin $C_H3$ domain. A non-limiting example of a multimerizing component is an Fc portion of an immunoglobulin (comprising a $C_H2$-$C_H3$ domain), e.g., an Fc domain of an IgG selected from the isotypes IgG1, IgG2, IgG3, and IgG4, as well as any allotype within each isotype group.

Bispecific antigen-binding molecules of the present invention will typically comprise two multimerizing domains, e.g., two Fc domains that are each individually part of a separate antibody heavy chain. The first and second multimerizing domains may be of the same IgG isotype such as, e.g., IgG1/IgG1, IgG2/IgG2, IgG4/IgG4. Alternatively, the first and second multimerizing domains may be of different IgG isotypes such as, e.g., IgG1/IgG2, IgG1/IgG4, IgG2/IgG4, etc.

In certain embodiments, the multimerizing domain is an Fc fragment or an amino acid sequence of from 1 to about 200 amino acids in length containing at least one cysteine residue. In other embodiments, the multimerizing domain is a cysteine residue, or a short cysteine-containing peptide. Other multimerizing domains include peptides or polypeptides comprising or consisting of a leucine zipper, a helix-loop motif, or a coiled-coil motif.

Any bispecific antibody format or technology may be used to make the bispecific antigen-binding molecules of the present invention. For example, an antibody or fragment thereof having a first antigen binding specificity can be functionally linked (e.g., by chemical coupling, genetic fusion, noncovalent association or otherwise) to one or more other molecular entities, such as another antibody or antibody fragment having a second antigen-binding specificity to produce a bispecific antigen-binding molecule. Specific exemplary bispecific formats that can be used in the context of the present invention include, without limitation, e.g., scFv-based or diabody bispecific formats, IgG-scFv fusions, dual variable domain (DVD)-Ig, Quadroma, knobs-into-holes, common light chain (e.g., common light chain with knobs-into-holes, etc.), CrossMab, CrossFab, (SEED) body, leucine zipper, Duobody, IgG1/IgG2, dual acting Fab (DAF)-IgG, and $Mab^2$ bispecific formats (see, e.g., Klein et al. 2012, mAbs 4:6, 1-11, and references cited therein, for a review of the foregoing formats).

In the context of bispecific antigen-binding molecules of the present invention, the multimerizing domains, e.g., Fc domains, may comprise one or more amino acid changes (e.g., insertions, deletions or substitutions) as compared to the wild-type, naturally occurring version of the Fc domain. For example, the invention includes bispecific antigen-binding molecules comprising one or more modifications in the Fc domain that results in a modified Fc domain having a modified binding interaction (e.g., enhanced or diminished) between Fc and FcRn. In one embodiment, the bispecific antigen-binding molecule comprises a modification in a $C_H2$ or a $C_H3$ region, wherein the modification increases the affinity of the Fc domain to FcRn in an acidic environment (e.g., in an endosome where pH ranges from about 5.5 to about 6.0). Non-limiting examples of such Fc modifications include, e.g., a modification at position 250 (e.g., E or Q); 250 and 428 (e.g., L or F); 252 (e.g., L/Y/F/W or T), 254 (e.g., S or T), and 256 (e.g., S/R/Q/E/D or T); or a modification at position 428 and/or 433 (e.g., L/R/S/P/Q or K) and/or 434 (e.g., H/F or Y); or a modification at position 250 and/or 428; or a modification at position 307 or 308 (e.g., 308F, V308F), and 434. In one embodiment, the modification comprises a 428L (e.g., M428L) and 434S (e.g., N434S) modification; a 428L, 259I (e.g., V259I), and 308F (e.g., V308F) modification; a 433K (e.g., H433K) and a 434 (e.g., 434Y) modification; a 252, 254, and 256 (e.g., 252Y, 254T, and 256E) modification; a 250Q and 428L modification (e.g., T250Q and M428L); and a 307 and/or 308 modification (e.g., 308F or 308P).

The present invention also includes bispecific antigen-binding molecules comprising a first $C_H3$ domain and a second Ig $C_H3$ domain, wherein the first and second Ig $C_H3$ domains differ from one another by at least one amino acid, and wherein at least one amino acid difference reduces binding of the bispecific antibody to Protein A as compared to a bi-specific antibody lacking the amino acid difference. In one embodiment, the first Ig $C_H3$ domain binds Protein A and the second Ig $C_H3$ domain contains a mutation that reduces or abolishes Protein A binding such as an H95R modification (by IMGT exon numbering; H435R by EU numbering). The second $C_H3$ may further comprise a Y96F modification (by IMGT; Y436F by EU). See, for example, U.S. Pat. No. 8,586,713. Further modifications that may be found within the second $C_H3$ include: D16E, L18M, N44S, K52N, V57M, and V82I (by IMGT; D356E, L358M, N384S, K392N, V397M, and V422I by EU) in the case of IgG1 antibodies; N44S, K52N, and V82I (IMGT; N384S, K392N, and V422I by EU) in the case of IgG2 antibodies; and Q15R, N44S, K52N, V57M, R69K, E79Q, and V82I (by IMGT; Q355R, N384S, K392N, V397M, R409K, E419Q, and V422I by EU) in the case of IgG4 antibodies.

In certain embodiments, the Fc domain may be chimeric, combining Fc sequences derived from more than one immunoglobulin isotype. For example, a chimeric Fc domain can comprise part or all of a $C_H2$ sequence derived from a human IgG1, human IgG2 or human IgG4 $C_H2$ region, and part or all of a $C_H3$ sequence derived from a human IgG1, human IgG2 or human IgG4. A chimeric Fc domain can also contain a chimeric hinge region. For example, a chimeric hinge may comprise an "upper hinge" sequence, derived from a human IgG1, a human IgG2 or a human IgG4 hinge region, combined with a "lower hinge" sequence, derived from a human IgG1, a human IgG2 or a human IgG4 hinge region. A particular example of a chimeric Fc domain that can be included in any of the antigen-binding molecules set forth herein comprises, from N- to C-terminus: [IgG4 $C_H1$]-[IgG4 upper hinge]-[IgG2 lower hinge]-[IgG4 CH2]-[IgG4 CH3]. Another example of a chimeric Fc domain that can be included in any of the antigen-binding molecules set forth herein comprises, from N- to C-terminus: [IgG1 $C_H1$]-[IgG1 upper hinge]-[IgG2 lower hinge]-[IgG4 CH2]-[IgG1 CH3]. These and other examples of chimeric Fc domains that can be included in any of the antigen-binding molecules of the present invention are described in US Publication 2014/0243504, published Aug. 28, 2014, which is herein incorporated in its entirety. Chimeric Fc domains having these general structural arrangements, and variants thereof, can have altered Fc receptor binding, which in turn affects Fc effector function.

In certain embodiments, the invention provides an antibody heavy chain wherein the heavy chain constant region (CH) region comprises an amino acid sequence at least 95%, at least 96%, at least 97%, at least 98%, at least 99% identical to any one of SEQ ID NO: 1663, SEQ ID NO: 1664, SEQ ID NO: 1665, SEQ ID NO: 1666, SEQ ID NO: 1667, SEQ ID NO: 1668, SEQ ID NO: 1669, SEQ ID NO: 1670 SEQ ID NO: 1671 or SEQ ID NO: 1672. In some embodiments, the heavy chain constant region (CH) region comprises an amino acid sequence selected from the group consisting of SEQ ID NO: 1663, SEQ ID NO: 1664, SEQ ID NO: 1665, SEQ ID NO: 1666, SEQ ID NO: 1667, SEQ ID NO: 1668, SEQ ID NO: 1669, SEQ ID NO: 1670, SEQ ID NO: 1671 and SEQ ID NO: 1672.

In other embodiments, the invention provides an antibody heavy chain wherein the Fc domain comprises an amino acid sequence at least 95%, at least 96%, at least 97%, at least 98%, at least 99% identical to any one of SEQ ID NO: 1673, SEQ ID NO: 1674, SEQ ID NO: 1675, SEQ ID NO: 1676, SEQ ID NO: 1677, SEQ ID NO: 1678, SEQ ID NO: 1679, SEQ ID NO: 1680, SEQ ID NO: 1681 or SEQ ID NO: 1682. In some embodiments, the Fc domain comprises an amino acid sequence selected form the group consisting of SEQ ID NO: 1673, SEQ ID NO: 1674, SEQ ID NO: 1675, SEQ ID NO: 1676, SEQ ID NO: 1677, SEQ ID NO: 1678, SEQ ID NO: 1679, SEQ ID NO: 1680, SEQ ID NO: 1681 and SEQ ID NO: 1682.

Sequence Variants

The antibodies and bispecific antigen-binding molecules of the present invention may comprise one or more amino acid substitutions, insertions and/or deletions in the framework and/or CDR regions of the heavy and light chain variable domains as compared to the corresponding germline sequences from which the individual antigen-binding domains were derived. Such mutations can be readily ascertained by comparing the amino acid sequences disclosed herein to germline sequences available from, for example, public antibody sequence databases. The antigen-binding molecules of the present invention may comprise antigen-binding domains which are derived from any of the exemplary amino acid sequences disclosed herein, wherein one or more amino acids within one or more framework and/or CDR regions are mutated to the corresponding residue(s) of the germline sequence from which the antibody was derived, or to the corresponding residue(s) of another human germline sequence, or to a conservative amino acid substitution of the corresponding germline residue(s) (such sequence changes are referred to herein collectively as "germline mutations"). A person of ordinary skill in the art, starting with the heavy and light chain variable region sequences disclosed herein, can easily produce numerous antibodies and antigen-binding fragments which comprise one or more individual germline mutations or combinations thereof. In certain embodiments, all of the framework and/or CDR residues within the $V_H$ and/or $V_L$ domains are mutated back to the residues found in the original germline sequence from which the antigen-binding domain was originally derived. In other embodiments, only certain residues are mutated back to the original germline sequence, e.g., only the mutated residues found within the first 8 amino acids of FR1 or within the last 8 amino acids of FR4, or only the mutated residues found within CDR1, CDR2 or CDR3. In other embodiments, one or more of the framework and/or CDR residue(s) are mutated to the corresponding residue(s) of a different germline sequence (i.e., a germline sequence that is different from the germline sequence from which the antigen-binding domain was originally derived). Furthermore, the antigen-binding domains may contain any combination of two or more germline mutations within the framework and/or CDR regions, e.g., wherein certain individual residues are mutated to the corresponding residue of a particular germline sequence while certain other residues that differ from the original germline sequence are maintained or are mutated to the corresponding residue of a different germline sequence. Once obtained, antigen-binding domains that contain one or more germline mutations can be easily tested for one or more desired property such as, improved binding specificity, increased binding affinity, improved or enhanced antagonistic or agonistic biological properties (as the case may be), reduced immunogenicity, etc. Bispecific antigen-binding molecules comprising one or more antigen-binding domains obtained in this general manner are encompassed within the present invention.

The present invention also includes antigen-binding molecules wherein one or both antigen-binding domains comprise variants of any of the HCVR, LCVR, and/or CDR amino acid sequences disclosed herein having one or more conservative substitutions. For example, the present invention includes antigen-binding molecules comprising an antigen-binding domain having HCVR, LCVR, and/or CDR amino acid sequences with, e.g., 10 or fewer, 8 or fewer, 6 or fewer, 4 or fewer, etc. conservative amino acid substitutions relative to any of the HCVR, LCVR, and/or CDR amino acid sequences disclosed herein. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. Examples of groups of amino acids that have side chains with similar chemical properties include (1) aliphatic side chains: glycine, alanine, valine, leucine and isoleucine; (2) aliphatic-hydroxyl side chains: serine and threonine; (3) amide-containing side chains: asparagine and glutamine; (4) aromatic side chains: phenylalanine, tyrosine, and tryptophan; (5) basic side chains: lysine, arginine, and histidine; (6) acidic side chains: aspartate and glutamate, and (7) sulfur-containing side chains are cysteine and methionine. Preferred conservative amino acids substitution groups are: valine-leucine-isoleucine, phenylalanine-tyrosine, lysine-arginine, alanine-valine, glutamate-aspartate, and asparagine-glutamine. Alternatively, a conservative replacement is any change having a positive value in the PAM250 log-likelihood matrix disclosed in Gonnet et al. (1992) Science 256: 1443-1445, herein incorporated by reference. A "moderately conservative" replacement is any change having a nonnegative value in the PAM250 log-likelihood matrix.

The present invention also includes antigen-binding molecules comprising an antigen-binding domain with an HCVR, LCVR, and/or CDR amino acid sequence that is substantially identical to any of the HCVR, LCVR, and/or CDR amino acid sequences disclosed herein. The term "substantial identity" or "substantially identical," when referring to an amino acid sequence means that two amino acid sequences, when optimally aligned, such as by the programs GAP or BESTFIT using default gap weights, share at least 95% sequence identity, even more preferably at least 98% or 99% sequence identity. Preferably, residue positions which are not identical differ by conservative amino acid substitutions. In cases where two or more amino acid sequences differ from each other by conservative substitutions, the percent sequence identity or degree of similarity may be adjusted upwards to correct for the conservative nature of the substitution. Means for making this adjustment are well-known to those of skill in the art. See, e.g., Pearson (1994) Methods Mol. Biol. 24: 307-331, herein incorporated by reference.

Sequence similarity for polypeptides, which is also referred to as sequence identity, is typically measured using sequence analysis software. Protein analysis software matches similar sequences using measures of similarity assigned to various substitutions, deletions and other modifications, including conservative amino acid substitutions. For instance, GCG software contains programs such as Gap and Bestfit which can be used with default parameters to determine sequence homology or sequence identity between closely related polypeptides, such as homologous polypeptides from different species of organisms or between a wild type protein and a mutein thereof. See, e.g., GCG Version 6.1. Polypeptide sequences also can be compared using FASTA using default or recommended parameters, a program in GCG Version 6.1. FASTA (e.g., FASTA2 and FASTA3) provides alignments and percent sequence identity of the regions of the best overlap between the query and search sequences (Pearson (2000) supra). Another preferred algorithm when comparing a sequence of the invention to a database containing a large number of sequences from different organisms is the computer program BLAST, especially BLASTP or TBLASTN, using default parameters. See, e.g., Altschul et al. (1990) J. Mol. Biol. 215:403-410 and Altschul et al. (1997) Nucleic Acids Res. 25:3389-402, each herein incorporated by reference.

pH-Dependent Binding

The present invention includes anti-PSMA antibodies, and anti-CD3/anti-PSMA bispecific antigen-binding molecules, with pH-dependent binding characteristics. For example, an anti-PSMA antibody of the present invention may exhibit reduced binding to PSMA at acidic pH as compared to neutral pH. Alternatively, anti-PSMA antibodies of the invention may exhibit enhanced binding to PSMA at acidic pH as compared to neutral pH. The expression “acidic pH” includes pH values less than about 6.2, e.g., about 6.0, 5.95, 5.9, 5.85, 5.8, 5.75, 5.7, 5.65, 5.6, 5.55, 5.5, 5.45, 5.4, 5.35, 5.3, 5.25, 5.2, 5.15, 5.1, 5.05, 5.0, or less. As used herein, the expression “neutral pH” means a pH of about 7.0 to about 7.4. The expression “neutral pH” includes pH values of about 7.0, 7.05, 7.1, 7.15, 7.2, 7.25, 7.3, 7.35, and 7.4.

In certain instances, “reduced binding . . . at acidic pH as compared to neutral pH” is expressed in terms of a ratio of the $K_D$ value of the antibody binding to its antigen at acidic pH to the $K_D$ value of the antibody binding to its antigen at neutral pH (or vice versa). For example, an antibody or antigen-binding fragment thereof may be regarded as exhibiting “reduced binding to PSMA at acidic pH as compared to neutral pH” for purposes of the present invention if the antibody or antigen-binding fragment thereof exhibits an acidic/neutral $K_D$ ratio of about 3.0 or greater. In certain exemplary embodiments, the acidic/neutral $K_D$ ratio for an antibody or antigen-binding fragment of the present invention can be about 3.0, 3.5, 4.0, 4.5, 5.0, 5.5, 6.0, 6.5, 7.0, 7.5, 8.0, 8.5, 9.0, 9.5, 10.0, 10.5, 11.0, 11.5, 12.0, 12.5, 13.0, 13.5, 14.0, 14.5, 15.0, 20.0. 25.0, 30.0, 40.0, 50.0, 60.0, 70.0, 100.0 or greater.

Antibodies with pH-dependent binding characteristics may be obtained, e.g., by screening a population of antibodies for reduced (or enhanced) binding to a particular antigen at acidic pH as compared to neutral pH. Additionally, modifications of the antigen-binding domain at the amino acid level may yield antibodies with pH-dependent characteristics. For example, by substituting one or more amino acids of an antigen-binding domain (e.g., within a CDR) with a histidine residue, an antibody with reduced antigen-binding at acidic pH relative to neutral pH may be obtained.

Antibodies Comprising Fc Variants

According to certain embodiments of the present invention, anti-PSMA antibodies, and anti-CD3/anti-PSMA bispecific antigen-binding molecules, are provided comprising an Fc domain comprising one or more mutations which enhance or diminish antibody binding to the FcRn receptor, e.g., at acidic pH as compared to neutral pH. For example, the present invention includes antibodies comprising a mutation in the $C_H2$ or a $C_H3$ region of the Fc domain, wherein the mutation(s) increases the affinity of the Fc domain to FcRn in an acidic environment (e.g., in an endosome where pH ranges from about 5.5 to about 6.0). Such mutations may result in an increase in serum half-life of the antibody when administered to an animal. Non-limiting examples of such Fc modifications include, e.g., a modification at position 250 (e.g., E or Q); 250 and 428 (e.g., L or F); 252 (e.g., L/Y/F/W or T), 254 (e.g., S or T), and 256 (e.g., S/R/Q/E/D or T); or a modification at position 428 and/or 433 (e.g., H/L/R/S/P/Q or K) and/or 434 (e.g., H/F or Y); or a modification at position 250 and/or 428; or a modification at position 307 or 308 (e.g., 308F, V308F), and 434. In one embodiment, the modification comprises a 428L (e.g., M428L) and 434S (e.g., N434S) modification; a 428L, 259I (e.g., V259I), and 308F (e.g., V308F) modification; a 433K (e.g., H433K) and a 434 (e.g., 434Y) modification; a 252, 254, and 256 (e.g., 252Y, 254T, and 256E) modification; a 250Q and 428L modification (e.g., T250Q and M428L); and a 307 and/or 308 modification (e.g., 308F or 308P).

For example, the present invention includes anti-PSMA antibodies, and anti-CD3/anti-PSMA bispecific antigen-binding molecules, comprising an Fc domain comprising one or more pairs or groups of mutations selected from the group consisting of: 250Q and 248L (e.g., T250Q and M248L); 252Y, 254T and 256E (e.g., M252Y, S254T and T256E); 428L and 434S (e.g., M428L and N434S); and 433K and 434F (e.g., H433K and N434F). All possible combinations of the foregoing Fc domain mutations, and other mutations within the antibody variable domains disclosed herein, are contemplated within the scope of the present invention.

Biological Characteristics of the Antibodies and Bispecific Antigen-Binding Molecules The present invention includes antibodies and antigen-binding fragments thereof that bind human PSMA with high affinity (e.g., sub-nanomolar $K_D$ values).

According to certain embodiments, the present invention includes antibodies and antigen-binding fragments of antibodies that bind human PSMA (e.g., at 37° C.) with a $K_D$ of less than about 80 nM as measured by surface plasmon resonance, e.g., using an assay format as defined in Example 3 herein. In certain embodiments, the antibodies or antigen-binding fragments of the present invention bind PSMA with a $K_D$ of less than about 5 nM, less than about 2 nM, less than about 1 nM, less than about 800 pM, less than about 600 pM, less than about 500 pM, less than about 400 pM, less than about 300 pM, less than about 200 pM, less than about 180 pM, less than about 160 pM, less than about 140 pM, less than about 120 pM, less than about 100 pM, less than about 80 pM, less than about 60 pM, less than about 40 pM, less than about 20 pM, or less than about 10 pM, as measured by surface plasmon resonance, e.g., using an assay format as defined in Example 3 herein (e.g., mAb-capture or antigen-capture format), or a substantially similar assay.

The present invention also includes antibodies and antigen-binding fragments thereof that bind PSMA with a dissociative half-life (t½) of greater than about 1 minute or greater than about 10 minutes as measured by surface plasmon resonance at 37° C., e.g., using an assay format as defined in Example 3 herein, or a substantially similar assay. In certain embodiments, the antibodies or antigen-binding fragments of the present invention bind PSMA with a t½ of greater than about 20 minutes, greater than about 30 minutes, greater than about 40 minutes, greater than about 50 minutes, greater than about 60 minutes, greater than about 70 minutes, greater than about 80 minutes, greater than about 90 minutes, greater than about 100 minutes, greater than about 200 minutes, greater than about 300 minutes, greater than about 400 minutes, greater than about 500 minutes, greater than about 600 minutes, greater than about 700 minutes, greater than about 800 minutes, greater than about 900 minutes, greater than about 1000 minutes, or greater than about 1100 minutes, as measured by surface plasmon resonance at 25° C. or 37° C., e.g., using an assay format as defined in Example 3 herein (e.g., mAb-capture or antigen-capture format), or a substantially similar assay. The present invention includes bispecific antigen-binding molecules (e.g., bispecific antibodies) which are capable of simultaneously binding to human CD3 and human PSMA. According to certain embodiments, the bispecific antigen-binding molecules of the invention specifically interact with cells that express CD3 and/or PSMA. The extent to which a bispecific antigen-binding molecule binds cells that express CD3 and/or PSMA can be assessed by fluorescence activated cell sorting (FACS), as illustrated in Example 5 herein. For example, the present invention includes bispecific antigen-binding molecules which specifically bind human T-cell lines which express CD3 (such cell lines do not express PSMA, e.g., Jurkat) and/or human lines which express PSMA (such cell lines do not express CD3, e.g., B16F10.9/hPSMA or 22RV1). The present invention includes bispecific antigen-binding molecules which bind any of the aforementioned cells and cell lines with an $EC_{50}$ value of about 80 nM, or less, as determined using a FACS assay as set forth in Example 5 or a substantially similar assay.

The present invention also includes anti-CD3/anti-PSMA bispecific antigen-binding molecules which bind to CD3-expressing human T-cells (e.g., Jurkat) and/or PSMA-expressing cells with an $EC_{50}$ value of between 1.0 pM and 1000 nM. In certain embodiments, the anti-CD3/anti-PSMA bispecific antigen-binding molecules bind to CD3-expressing human T-cells with an EC50 value of between 1 nM and 60 nM. For example, the present invention includes anti-CD3/anti-PSMA bispecific antigen-binding molecules which bind to CD3-expressing human T-cells (e.g., Jurkat) and/or PSMA-expressing cells with an $EC_{50}$ value of about 1 pM. about 10 pM, about 100 pM, about 500 pM, about 1 nM, about 2 nM, about 5 nM, about 10 nM, about 20 nM, about 30 nM, about 40 nM, about 50 nM about 60 nM, about 70 nM, about 80 nM, about 90 nM, about 100 nM, about 200 nM, about 300 nM, about 500 nM, about 800 nM, about 1000 nM, or more.

The present invention also includes anti-CD3/anti-PSMA bispecific antigen-binding molecules which exhibit one or more characteristics selected from the group consisting of: (a) inhibiting tumor growth in immunocompromised mice bearing human prostate cancer xenografts; (b) inhibiting tumor growth in immunocompetent mice bearing human prostate cancer xenografts; (c) suppressing tumor growth of established tumors in immunocompromised mice bearing human prostate cancer xenografts; and (d) reducing tumor growth of established tumors in immunocompetent mice bearing human prostate cancer xenografts (see, e.g., Example 8).

The present invention includes antibodies and antigen-binding fragments thereof that bind human CD3 with high affinity. The present invention also includes antibodies and antigen-binding fragments thereof that bind human CD3 with medium or low affinity, depending on the therapeutic context and particular targeting properties that are desired. For example, in the context of a bispecific antigen-binding molecule, wherein one arm binds CD3 and another arm binds a target antigen (e.g., PSMA), it may be desirable for the target antigen-binding arm to bind the target antigen with high affinity while the anti-CD3 arm binds CD3 with only moderate or low affinity. In this manner, preferential targeting of the antigen-binding molecule to cells expressing the target antigen may be achieved while avoiding general/untargeted CD3 binding and the consequent adverse side effects associated therewith.

The present invention includes bispecific antigen-binding molecules (e.g., bispecific antibodies) which are capable of simultaneously binding to human CD3 and a human PSMA. The binding arm that interacts with cells that express CD3 may have weak to no detectable binding as measured in a suitable in vitro binding assay. The extent to which a bispecific antigen-binding molecule binds cells that express CD3 and/or PSMA can be assessed by fluorescence activated cell sorting (FACS), as illustrated in Example 5 herein.

For example, the present invention includes antibodies, antigen-binding fragments, and bispecific antibodies thereof which specifically bind human T-cell lines which express CD3 but do not express PSMA (e.g., Jurkat), primate T-cells (e.g., cynomolgus peripheral blood mononuclear cells [PBMCs]), and/or PSMA-expressing cells. The present invention includes bispecific antigen-binding molecules which bind any of the aforementioned T cells and T cell lines with an $EC_{50}$ value of from about $1.8\times10^{-8}$ (18 nM) to about $2.1\times10^{-7}$ (210 nM), or more (i.e. weaker affinity), or $EC_{50}$ is undetectable, as determined using a FACS binding assay as set forth in Example 5 or a substantially similar assay. In certain embodiments, the antibodies, antigen-binding fragments, and bispecific antibodies of the present invention bind CD3 with an $EC_{50}$ of greater than about 30 nM, greater than about 40 nM, greater than about 45 nM, greater than about 50 nM, greater than about 55 nM, greater than about 60 nM, greater than about 65 nM, greater than about 70 nM, greater than about 75 nM, at least 80 nM, greater than about 90 nM, greater than about 100 nM, greater than about 110 nM, at least 120 nM, greater than about 130 nM, greater than about 140 nM, greater than about 150 nM, at least 160 nM, greater than about 170 nM, greater than about 180 nM, greater than about 190 nM, greater than about 200 nM, greater than about 250 nM, greater than about 300 nM, greater than about 1 μM, greater than about 2 μM, or greater than about 3 μM, or no detectable affinity, as measured by FACS binding, e.g., using an assay format as defined in Example 5 herein, or a substantially similar assay.

The present invention also includes antibodies, antigen-binding fragments, and bispecific antibodies thereof which bind to PSMA-expressing cells and cell lines, with an $EC_{50}$ value of less than or equal to 5.6 nM ($5.6\times10^{-9}$), as determined using a FACS binding assay as set forth in Example 5 or a substantially similar assay.

The present invention includes antibodies, antigen-binding fragments, and bispecific antibodies thereof that bind human CD3 with weak (i.e. low) or even no detectable affinity. According to certain embodiments, the present invention includes antibodies and antigen-binding fragments of antibodies that bind human CD3 (e.g., at 37° C.) with a $K_D$ of greater than about 11 nM as measured by surface plasmon resonance, e.g., using an assay format as defined in Example 6 herein. In certain embodiments, the antibodies or antigen-binding fragments of the present invention bind CD3 with a $K_D$ of greater than about 15 nM, greater than about 20 nM, greater than about 25 nM, greater than about 30 nM, greater than about 35 nM, greater than about 40 nM, greater than about 45 nM, greater than about 50 nM, greater than about 55 nM, greater than about 60 nM, greater than about 65 nM, greater than about 70 nM, greater than about 75 nM, at least 80 nM, greater than about 90 nM, greater than about 100 nM, greater than about 110 nM, at least 120 nM, greater than about 130 nM, greater than about 140 nM, greater than about 150 nM, at least 160 nM, greater than about 170 nM, greater than about 180 nM, greater than about 190 nM, greater than about 200 nM, greater than about 250 nM, greater than about 300 nM, greater than about 1 μM, greater than about 2 μM, or greater than about 3 μM, or no detectable affinity, as measured by surface plasmon resonance, e.g., using an assay format as defined in Example 6 herein (e.g., mAb-capture or antigen-capture format), or a substantially similar assay.

The present invention includes antibodies, antigen-binding fragments, and bispecific antibodies thereof that bind monkey (i.e. cynomolgus) CD3 with weak (i.e. low) or even no detectable affinity. According to certain embodiments, the present invention includes antibodies, antigen-binding fragments, and bispecific antibodies thereof that bind human CD3 (e.g., at 37° C.) with a $K_D$ of greater than about 10 nM as measured by surface plasmon resonance, e.g., using an assay format as defined in Example 6 herein. In certain embodiments, the antibodies or antigen-binding fragments of the present invention bind CD3 with a $K_D$ of greater than about 15 nM, greater than about 20 nM, greater than about 25 nM, greater than about 30 nM, greater than about 35 nM, greater than about 40 nM, greater than about 45 nM, greater than about 50 nM, greater than about 55 nM, greater than about 60 nM, greater than about 65 nM, greater than about 70 nM, greater than about 75 nM, at least 80 nM, greater than about 90 nM, greater than about 100 nM, greater than about 110 nM, at least 120 nM, greater than about 130 nM, greater than about 140 nM, greater than about 150 nM, at least 160 nM, greater than about 170 nM, greater than about 180 nM, greater than about 190 nM, greater than about 200 nM, greater than about 250 nM, greater than about 300 nM, greater than about 1 μM, greater than about 2 μM, or greater than about 3 μM, or no detectable affinity, as measured by surface plasmon resonance, e.g., using an assay format as defined in Example 6 herein (e.g., mAb-capture or antigen-capture format), or a substantially similar assay.

The present invention includes antibodies, antigen-binding fragments, and bispecific antibodies thereof that bind human CD3 and induce T cell activation. For example, the present invention includes anti-CD3 antibodies that induce human T cell activation with an $EC_{50}$ value of less than about 113 pM, as measured by an in vitro T cell activation assay, e.g., using the assay format as defined in Example 7 herein [e.g., assessing the percent activated (CD69+) cells out of total T cells (CD2+) in the presence of anti-CD3 antibodies], or a substantially similar assay that assesses T cell in their activated state. In certain embodiments, the antibodies or antigen-binding fragments of the present invention induce human T cell activation [e.g., percent activated (CD69+) T cells] with an $EC_{50}$ value of less than about 100 pM, less than about 50 pM, less than about 20 pM, less than about 19 pM, less than about 18 pM, less than about 17 pM, less than about 16 pM, less than about 15 pM, less than about 14 pM, less than about 13 pM, less than about 12 pM, less than about 11 pM, less than about 10 pM, less than about 9 pM, less than about 8 pM, less than about 7 pM, less than about 6 pM, less than about 5 pM, less than about 4 pM, less than about 3 pM, less than about 2 pM, or less than about 1 pM, as measured by an in vitro T cell activation assay, e.g., using the assay format as defined in Example 7 herein, or a substantially similar assay. Anti-CD3 antibodies that have weak or no detectable binding to CD3 have the ability to induce T cell activation with high potency (i.e. pM range), despite having weak or no detectable binding affinity to CD3, as exemplified in Example 7 herein.

The present invention also includes antibodies, antigen-binding fragments, and bispecific antibodies that bind human CD3 and induce T cell-mediated killing of tumor antigen-expressing cells. For example, the present invention includes anti-CD3 antibodies that induce T cell-mediated killing of tumor cells with an $EC_{50}$ of less than about 1.3 nM, as measured in an in vitro T cell-mediated tumor cell killing assay, e.g., using the assay format as defined in Example 7 herein (e.g., assessing the extent of PSMA-expressing cell killing by human PBMCs in the presence of anti-CD3 antibodies), or a substantially similar assay. In certain embodiments, the antibodies or antigen-binding fragments of the present invention induce T cell-mediated tumor cell killing (e.g., PBMC-mediated killing of C4-2, 22Rv1 and TRAMPC2_PSMA cells) with an $EC_{50}$ value of less than about 1 nM, less than about 400 pM, less than about 250 pM, less than about 100 pM, less than about 50 pM, less than about 40 pM, less than about 30 pM, less than about 20 pM, less than about 10 pM, less than about 9 pM, less than about 8 pM, less than about 7 pM, less than about 6 pM, less than about 5 pM, less than about 4 pM, less than about 3 pM, less than about 2 pM, or less than about 1 pM, as measured by an in vitro T cell-mediated tumor cell killing assay, e.g., using the assay format as defined in Example 7 herein, or a substantially similar assay. The present invention also includes antibodies, antigen-binding fragments, and bispecific antibodies that bind human and/or monkey (i.e. cynomolgus) CD3 with weak (i.e. low) or even no detectable affinity (i.e. do not bind or exhibit no detectable affinity) and induce T cell-mediated killing of tumor antigen-expressing cells.

The present invention also includes antibodies, antigen-binding fragments, and bispecific antibodies that bind CD3 with a dissociative half-life (t½) of less than about 10 minutes as measured by surface plasmon resonance at 25° C. or 37° C., e.g., using an assay format as defined in Example 6 herein, or a substantially similar assay. In certain embodiments, the antibodies or antigen-binding fragments of the present invention bind CD3 with a t½ of less than about 9 minutes, of less than about 8 minutes, of less than about 7 minutes, of less than about 6 minutes, of less than about 5 minutes, of less than about 4 minutes, of less than about 3 minutes, of less than about 2 minutes, of less than about 1.9 minutes, or less than about 1.8 minutes, or exhibit very weak or no detectable binding as measured by surface plasmon resonance at 25° C. or 37° C., e.g., using an assay format as defined in Example 6 herein (e.g., mAb-capture or antigen-capture format), or a substantially similar assay.

The anti-CD3/anti-PSMA bispecific antigen-binding molecules of the present invention may additionally exhibit one or more characteristics selected from the group consisting of: (a) inducing PBMC proliferation in vitro; (b) activating T-cells via inducing IFN-gamma release and CD25 up-regulation in human whole blood; and (c) inducing T-cell mediated cytotoxicity on anti-PSMA-resistant cell lines.

The present invention includes anti-CD3/anti-PSMA bispecific antigen-binding molecules which are capable of depleting tumor antigen-expressing cells in a subject (see, e.g., Example 8). For example, according to certain embodiments, anti-CD3/anti-PSMA bispecific antigen-binding molecules are provided, wherein a single administration of 1 μg, or 10 μg, or 100 μg of the bispecific antigen-binding molecule to a subject (e.g., at a dose of about 0.1 mg/kg, about 0.08 mg/kg, about 0.06 mg/kg about 0.04 mg/kg, about 0.04 mg/kg, about 0.02 mg/kg, about 0.01 mg/kg, or less) causes a reduction in the number of PSMA-expressing cells in the subject (e.g., tumor growth in the subject is suppressed or inhibited) below detectable levels. In certain embodiments, a single administration of the anti-CD3/anti-PSMA bispecific antigen-binding molecule at a dose of about 0.4 mg/kg causes a reduction in tumor growth in the subject below detectable levels by about day 7, about day 6, about day 5, about day 4, about day 3, about day 2, or about day 1 after administration of the bispecific antigen-binding molecule to the subject. According to certain embodiments, a single administration of an anti-CD3/anti-PSMA bispecific antigen-binding molecule of the invention, at a dose of at least about 0.01 mg/kg, causes the number of PSMA-expressing tumor cells to remain below detectable levels until at least about 7 days, 8 days, 9 days, 10 days, 11 days, 12 days, 13 days, 14 days, 15 days, 16 days, 17 days or more, following the administration. As used herein, the expression "below detectable levels" means that no tumor cells can be directly or indirectly detected growing subcutaneously in a subject using standard caliper measurement methods, e.g., as set forth in Example 8, herein.

The present invention also includes anti-CD3/anti-PSMA bispecific antigen-binding molecules which exhibit one or more characteristics selected from the group consisting of: (a) inhibiting tumor growth in immunocompromised mice bearing human prostate cancer xenografts; (b) inhibiting tumor growth in immunocompetent mice bearing human prostate cancer xenografts; (c) suppressing tumor growth of established tumors in immunocompromised mice bearing human prostate cancer xenografts; and (d) reducing tumor growth of established tumors in immunocompetent mice bearing human prostate cancer xenografts (see, e.g., Example 8). The present invention also includes anti-CD3/anti-PSMA bispecific antigen-binding molecules which exhibit one or more characteristics selected from the group consisting of: (a) induce transient dose-dependent increases in circulating cytokines, (b) induce transient increases in circulating T cells, and (c) do not deplete effector T cell cells (e.g. CD4+ T cells, CD8+ T cells, and regulatory T cells, i.e. Tregs).

Epitope Mapping and Related Technologies

The epitope on CD3 and/or PSMA to which the antigen-binding molecules of the present invention bind may consist of a single contiguous sequence of 3 or more (e.g., 3, 4, 5, 6, 7, 8, 9, 10, 11, 12, 13, 14, 15, 16, 17, 18, 19, 20 or more) amino acids of a CD3 or PSMA protein. Alternatively, the epitope may consist of a plurality of non-contiguous amino acids (or amino acid sequences) of CD3 or PSMA. The antibodies of the invention may interact with amino acids contained within a single CD3 chain (e.g., CD3-epsilon, CD3-delta or CD3-gamma), or may interact with amino acids on two or more different CD3 chains. The term "epitope," as used herein, refers to an antigenic determinant that interacts with a specific antigen binding site in the variable region of an antibody molecule known as a paratope. A single antigen may have more than one epitope. Thus, different antibodies may bind to different areas on an antigen and may have different biological effects. Epitopes may be either conformational or linear. A conformational epitope is produced by spatially juxtaposed amino acids from different segments of the linear polypeptide chain. A linear epitope is one produced by adjacent amino acid residues in a polypeptide chain. In certain circumstances, an epitope may include moieties of saccharides, phosphoryl groups, or sulfonyl groups on the antigen.

Various techniques known to persons of ordinary skill in the art can be used to determine whether an antigen-binding domain of an antibody "interacts with one or more amino acids" within a polypeptide or protein. Exemplary techniques include, e.g., routine cross-blocking assay such as that described *Antibodies*, Harlow and Lane (Cold Spring Harbor Press, Cold Spring Harb., N.Y.), alanine scanning mutational analysis, peptide blots analysis (Reineke, 2004, Methods Mol Biol 248:443-463), and peptide cleavage analysis. In addition, methods such as epitope excision, epitope extraction and chemical modification of antigens can be employed (Tomer, 2000, Protein Science 9:487-496). Another method that can be used to identify the amino acids within a polypeptide with which an antigen-binding domain of an antibody interacts is hydrogen/deuterium exchange detected by mass spectrometry. In general terms, the hydrogen/deuterium exchange method involves deuterium-labeling the protein of interest, followed by binding the antibody to the deuterium-labeled protein. Next, the protein/antibody complex is transferred to water to allow hydrogen-deuterium exchange to occur at all residues except for the residues protected by the antibody (which remain deuterium-labeled). After dissociation of the antibody, the target protein is subjected to protease cleavage and mass spectrometry analysis, thereby revealing the deuterium-labeled residues which correspond to the specific amino acids with which the antibody interacts. See, e.g., Ehring (1999) *Analytical Biochemistry* 267(2):252-259; Engen and Smith (2001) *Anal. Chem.* 73:256A-265A. X-ray crystallography of the antigen/antibody complex may also be used for epitope mapping purposes.

The present invention further includes anti-PSMA antibodies that bind to the same epitope as any of the specific exemplary antibodies described herein (e.g. antibodies comprising any of the amino acid sequences as set forth in Table 1 herein). Likewise, the present invention also includes anti-PSMA antibodies that compete for binding to PSMA with any of the specific exemplary antibodies described herein (e.g. antibodies comprising any of the amino acid sequences as set forth in Table 1 herein).

The present invention also includes bispecific antigen-binding molecules comprising a first antigen-binding domain that specifically binds human CD3 and/or cynomolgus CD3 with low or detectable binding affinity, and a second antigen binding domain that specifically binds human PSMA, wherein the first antigen-binding domain binds to the same epitope on CD3 as any of the specific exemplary CD3-specific antigen-binding domains described herein, and/or wherein the second antigen-binding domain binds to the same epitope on PSMA as any of the specific exemplary PSMA-specific antigen-binding domains described herein.

Likewise, the present invention also includes bispecific antigen-binding molecules comprising a first antigen-binding domain that specifically binds human CD3, and a second antigen binding domain that specifically binds human PSMA, wherein the first antigen-binding domain competes for binding to CD3 with any of the specific exemplary CD3-specific antigen-binding domains described herein, and/or wherein the second antigen-binding domain competes for binding to PSMA with any of the specific exemplary PSMA-specific antigen-binding domains described herein.

One can easily determine whether a particular antigen-binding molecule (e.g., antibody) or antigen-binding domain thereof binds to the same epitope as, or competes for binding with, a reference antigen-binding molecule of the present invention by using routine methods known in the art. For example, to determine if a test antibody binds to the same epitope on PSMA (or CD3) as a reference bispecific antigen-binding molecule of the present invention, the reference bispecific molecule is first allowed to bind to a PSMA protein (or CD3 protein). Next, the ability of a test antibody to bind to the PSMA (or CD3) molecule is assessed. If the test antibody is able to bind to PSMA (or CD3) following saturation binding with the reference bispecific antigen-binding molecule, it can be concluded that the test antibody binds to a different epitope of PSMA (or CD3) than the reference bispecific antigen-binding molecule. On the other hand, if the test antibody is not able to bind to the PSMA (or CD3) molecule following saturation binding with the reference bispecific antigen-binding molecule, then the test antibody may bind to the same epitope of PSMA (or CD3) as the epitope bound by the reference bispecific antigen-binding molecule of the invention. Additional routine experimentation (e.g., peptide mutation and binding analyses) can then be carried out to confirm whether the observed lack of binding of the test antibody is in fact due to binding to the same epitope as the reference bispecific antigen-binding molecule or if steric blocking (or another phenomenon) is responsible for the lack of observed binding. Experiments of this sort can be performed using ELISA, RIA, Biacore™, flow cytometry or any other quantitative or qualitative antibody-binding assay available in the art. In accordance with certain embodiments of the present invention, two antigen-binding proteins bind to the same (or overlapping) epitope if, e.g., a 1-, 5-, 10-, 20- or 100-fold excess of one antigen-binding protein inhibits binding of the other by at least 50% but preferably 75%, 90% or even 99% as measured in a competitive binding assay (see, e.g., Junghans et al., Cancer Res. 1990:50:1495-1502). Alternatively, two antigen-binding proteins are deemed to bind to the same epitope if essentially all amino acid mutations in the antigen that reduce or eliminate binding of one antigen-binding protein reduce or eliminate binding of the other. Two antigen-binding proteins are deemed to have "overlapping epitopes" if only a subset of the amino acid mutations that reduce or eliminate binding of one antigen-binding protein reduce or eliminate binding of the other.

To determine if an antibody or antigen-binding domain thereof competes for binding with a reference antigen-binding molecule, the above-described binding methodology is performed in two orientations: In a first orientation, the reference antigen-binding molecule is allowed to bind to a PSMA protein (or CD3 protein) under saturating conditions followed by assessment of binding of the test antibody to the PSMA (or CD3) molecule. In a second orientation, the test antibody is allowed to bind to a PSMA (or CD3) molecule under saturating conditions followed by assessment of binding of the reference antigen-binding molecule to the PSMA (or CD3) molecule. If, in both orientations, only the first (saturating) antigen-binding molecule is capable of binding to the PSMA (or CD3) molecule, then it is concluded that the test antibody and the reference antigen-binding molecule compete for binding to PSMA (or CD3). As will be appreciated by a person of ordinary skill in the art, an antibody that competes for binding with a reference antigen-binding molecule may not necessarily bind to the same epitope as the reference antibody, but may sterically block binding of the reference antibody by binding an overlapping or adjacent epitope.

Preparation of Antigen-Binding Domains and Construction of Bispecific Molecules

Antigen-binding domains specific for particular antigens can be prepared by any antibody generating technology known in the art. Once obtained, two different antigen-binding domains, specific for two different antigens (e.g., CD3 and PSMA), can be appropriately arranged relative to one another to produce a bispecific antigen-binding molecule of the present invention using routine methods. (A discussion of exemplary bispecific antibody formats that can be used to construct the bispecific antigen-binding molecules of the present invention is provided elsewhere herein). In certain embodiments, one or more of the individual components (e.g., heavy and light chains) of the multispecific antigen-binding molecules of the invention are derived from chimeric, humanized or fully human antibodies. Methods for making such antibodies are well known in the art. For example, one or more of the heavy and/or light chains of the bispecific antigen-binding molecules of the present invention can be prepared using VELOCIMMUNE™ technology. Using VELOCIMMUNE™ technology (or any other human antibody generating technology), high affinity chimeric antibodies to a particular antigen (e.g., CD3 or PSMA) are initially isolated having a human variable region and a mouse constant region. The antibodies are characterized and selected for desirable characteristics, including affinity, selectivity, epitope, etc. The mouse constant regions are replaced with a desired human constant region to generate fully human heavy and/or light chains that can be incorporated into the bispecific antigen-binding molecules of the present invention.

Genetically engineered animals may be used to make human bispecific antigen-binding molecules. For example, a genetically modified mouse can be used which is incapable of rearranging and expressing an endogenous mouse immunoglobulin light chain variable sequence, wherein the mouse expresses only one or two human light chain variable domains encoded by human immunoglobulin sequences operably linked to the mouse kappa constant gene at the endogenous mouse kappa locus. Such genetically modified mice can be used to produce fully human bispecific antigen-binding molecules comprising two different heavy chains that associate with an identical light chain that comprises a variable domain derived from one of two different human light chain variable region gene segments. (See, e.g., US 2011/0195454 for a detailed discussion of such engineered mice and the use thereof to produce bispecific antigen-binding molecules).

Bioequivalents

The present invention encompasses antigen-binding molecules having amino acid sequences that vary from those of the exemplary molecules disclosed herein but that retain the ability to bind CD3 and/or PSMA. Such variant molecules may comprise one or more additions, deletions, or substitutions of amino acids when compared to parent sequence, but exhibit biological activity that is essentially equivalent to that of the described bispecific antigen-binding molecules.

The present invention includes antigen-binding molecules that are bioequivalent to any of the exemplary antigen-binding molecules set forth herein. Two antigen-binding proteins, or antibodies, are considered bioequivalent if, for example, they are pharmaceutical equivalents or pharmaceutical alternatives whose rate and extent of absorption do not show a significant difference when administered at the same molar dose under similar experimental conditions, either single does or multiple dose. Some antigen-binding proteins will be considered equivalents or pharmaceutical alternatives if they are equivalent in the extent of their absorption but not in their rate of absorption and yet may be considered bioequivalent because such differences in the rate of absorption are intentional and are reflected in the labeling, are not essential to the attainment of effective body drug concentrations on, e.g., chronic use, and are considered medically insignificant for the particular drug product studied.

In one embodiment, two antigen-binding proteins are bioequivalent if there are no clinically meaningful differences in their safety, purity, and potency.

In one embodiment, two antigen-binding proteins are bioequivalent if a patient can be switched one or more times between the reference product and the biological product without an expected increase in the risk of adverse effects, including a clinically significant change in immunogenicity, or diminished effectiveness, as compared to continued therapy without such switching.

In one embodiment, two antigen-binding proteins are bioequivalent if they both act by a common mechanism or mechanisms of action for the condition or conditions of use, to the extent that such mechanisms are known.

Bioequivalence may be demonstrated by in vivo and in vitro methods. Bioequivalence measures include, e.g., (a) an in vivo test in humans or other mammals, in which the concentration of the antibody or its metabolites is measured in blood, plasma, serum, or other biological fluid as a function of time; (b) an in vitro test that has been correlated with and is reasonably predictive of human in vivo bioavailability data; (c) an in vivo test in humans or other mammals in which the appropriate acute pharmacological effect of the antibody (or its target) is measured as a function of time; and (d) in a well-controlled clinical trial that establishes safety, efficacy, or bioavailability or bioequivalence of an antigen-binding protein.

Bioequivalent variants of the exemplary bispecific antigen-binding molecules set forth herein may be constructed by, for example, making various substitutions of residues or sequences or deleting terminal or internal residues or sequences not needed for biological activity. For example, cysteine residues not essential for biological activity can be deleted or replaced with other amino acids to prevent formation of unnecessary or incorrect intramolecular disulfide bridges upon renaturation. In other contexts, bioequivalent antigen-binding proteins may include variants of the exemplary bispecific antigen-binding molecules set forth herein comprising amino acid changes which modify the glycosylation characteristics of the molecules, e.g., mutations which eliminate or remove glycosylation.

Species Selectivity and Species Cross-Reactivity

According to certain embodiments of the invention, antigen-binding molecules are provided which bind to human CD3 but not to CD3 from other species. Also provided are antigen-binding molecules which bind to human PSMA but not to PSMA from other species. The present invention also includes antigen-binding molecules that bind to human CD3 and to CD3 from one or more non-human species; and/or antigen-binding molecules that bind to human PSMA and to PSMA from one or more non-human species.

According to certain exemplary embodiments of the invention, antigen-binding molecules are provided which bind to human CD3 and/or human PSMA and may bind or not bind, as the case may be, to one or more of mouse, rat, guinea pig, hamster, gerbil, pig, cat, dog, rabbit, goat, sheep, cow, horse, camel, cynomolgus, marmoset, rhesus or chimpanzee CD3 and/or PSMA. For example, in a particular exemplary embodiment of the present invention bispecific antigen-binding molecules are provided comprising a first antigen-binding domain that binds human CD3 and cynomolgus CD3, and a second antigen-binding domain that specifically binds human PSMA.

Immunoconjugates

The present invention encompasses antigen-binding molecules conjugated to a therapeutic moiety ("immunoconjugate"), such as a cytotoxin, a chemotherapeutic drug, an immunosuppressant or a radioisotope. Cytotoxic agents include any agent that is detrimental to cells. Examples of suitable cytotoxic agents and chemotherapeutic agents for forming immunoconjugates are known in the art, (see for example, WO 05/103081).

Therapeutic Formulation and Administration

The present invention provides pharmaceutical compositions comprising the antigen-binding molecules of the present invention. The pharmaceutical compositions of the invention are formulated with suitable carriers, excipients, and other agents that provide improved transfer, delivery, tolerance, and the like. A multitude of appropriate formulations can be found in the formulary known to all pharmaceutical chemists: Remington's Pharmaceutical Sciences, Mack Publishing Company, Easton, Pa. These formulations include, for example, powders, pastes, ointments, jellies, waxes, oils, lipids, lipid (cationic or anionic) containing vesicles (such as LIPOFECTIN™, Life Technologies, Carlsbad, Calif.), DNA conjugates, anhydrous absorption pastes, oil-in-water and water-in-oil emulsions, emulsions carbowax (polyethylene glycols of various molecular weights), semi-solid gels, and semi-solid mixtures containing carbowax. See also Powell et al. "Compendium of excipients for parenteral formulations" PDA (1998) J Pharm Sci Technol 52:238-311.

The dose of antigen-binding molecule administered to a patient may vary depending upon the age and the size of the patient, target disease, conditions, route of administration, and the like. The preferred dose is typically calculated according to body weight or body surface area. When a bispecific antigen-binding molecule of the present invention is used for therapeutic purposes in an adult patient, it may be advantageous to intravenously administer the bispecific antigen-binding molecule of the present invention normally at a single dose of about 0.01 to about 20 mg/kg body weight, more preferably about 0.02 to about 7, about 0.03 to about 5, or about 0.05 to about 3 mg/kg body weight. Depending on the severity of the condition, the frequency and the duration of the treatment can be adjusted. Effective dosages and schedules for administering a bispecific antigen-binding molecule may be determined empirically; for example, patient progress can be monitored by periodic assessment, and the dose adjusted accordingly. Moreover, interspecies scaling of dosages can be performed using well-known methods in the art (e.g., Mordenti et al., 1991, *Pharmaceut. Res.* 8:1351).

Various delivery systems are known and can be used to administer the pharmaceutical composition of the invention, e.g., encapsulation in liposomes, microparticles, microcapsules, recombinant cells capable of expressing the mutant viruses, receptor mediated endocytosis (see, e.g., Wu et al., 1987, J. Biol. Chem. 262:4429-4432). Methods of introduction include, but are not limited to, intradermal, intramuscular, intraperitoneal, intravenous, subcutaneous, intranasal, epidural, and oral routes. The composition may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local.

A pharmaceutical composition of the present invention can be delivered subcutaneously or intravenously with a standard needle and syringe. In addition, with respect to subcutaneous delivery, a pen delivery device readily has applications in delivering a pharmaceutical composition of the present invention. Such a pen delivery device can be reusable or disposable. A reusable pen delivery device generally utilizes a replaceable cartridge that contains a pharmaceutical composition. Once all of the pharmaceutical composition within the cartridge has been administered and the cartridge is empty, the empty cartridge can readily be discarded and replaced with a new cartridge that contains the pharmaceutical composition. The pen delivery device can then be reused. In a disposable pen delivery device, there is no replaceable cartridge. Rather, the disposable pen delivery device comes prefilled with the pharmaceutical composition held in a reservoir within the device. Once the reservoir is emptied of the pharmaceutical composition, the entire device is discarded.

Numerous reusable pen and autoinjector delivery devices have applications in the subcutaneous delivery of a pharmaceutical composition of the present invention. Examples include, but are not limited to AUTOPEN™ (Owen Mumford, Inc., Woodstock, UK), DISETRONIC™ pen (Disetronic Medical Systems, Bergdorf, Switzerland), HUMALOG MIX 75/25™ pen, HUMALOG™ pen, HUMALIN 70/30™ pen (Eli Lilly and Co., Indianapolis, Ind.), NOVOPEN™ I, II and III (Novo Nordisk, Copenhagen, Denmark), NOVOPEN JUNIOR™ (Novo Nordisk, Copenhagen, Denmark), BD™ pen (Becton Dickinson, Franklin Lakes, N.J.), OPTIPEN™, OPTIPEN PRO™, OPTIPEN STARLET™, and OPTICLIK™ (sanofi-aventis, Frankfurt, Germany), to name only a few. Examples of disposable pen delivery devices having applications in subcutaneous delivery of a pharmaceutical composition of the present invention include, but are not limited to the SOLOSTAR™ pen (sanofi-aventis), the FLEXPEN™ (Novo Nordisk), and the KWIKPEN™ (Eli Lilly), the SURECLICK™ Autoinjector (Amgen, Thousand Oaks, Calif.), the PENLET™ (Haselmeier, Stuttgart, Germany), the EPIPEN (Dey, L.P.), and the HUMIRA™ Pen (Abbott Labs, Abbott Park Ill.), to name only a few.

t SEQ Paragraph \#"[0000]" * MERGEFORMAT*MERGEFORMAT [0207] In controlled release system. In one embodiment, a pump may be used (see Langer, supra; Sefton, 1987, CRC Crit. Ref. Biomed. Eng. 14:201). In another embodiment, polymeric materials can be used; see, Medical Applications of Controlled Release, Langer and Wise (eds.), 1974, CRC Pres., Boca Raton, Fla. In yet another embodiment, a controlled release system can be placed in proximity of the composition's target, thus requiring only a fraction of the systemic dose (see, e.g., Goodson, 1984, in Medical Applications of Controlled Release, supra, vol. 2, pp. 115-138). Other controlled release systems are discussed in the review by Langer, 1990, Science 249:1527-1533.

The injectable preparations may include dosage forms for intravenous, subcutaneous, intracutaneous and intramuscular injections, drip infusions, etc. These injectable preparations may be prepared by methods publicly known. For example, the injectable preparations may be prepared, e.g., by dissolving, suspending or emulsifying the antibody or its salt described above in a sterile aqueous medium or an oily medium conventionally used for injections. As the aqueous medium for injections, there are, for example, physiological saline, an isotonic solution containing glucose and other auxiliary agents, etc., which may be used in combination with an appropriate solubilizing agent such as an alcohol (e.g., ethanol), a polyalcohol (e.g., propylene glycol, polyethylene glycol), a nonionic surfactant [e.g., polysorbate 80, HCO-50 (polyoxyethylene (50 mol) adduct of hydrogenated castor oil)], etc. As the oily medium, there are employed, e.g., sesame oil, soybean oil, etc., which may be used in combination with a solubilizing agent such as benzyl benzoate, benzyl alcohol, etc. The injection thus prepared is preferably filled in an appropriate ampoule.

Advantageously, the pharmaceutical compositions for oral or parenteral use described above are prepared into dosage forms in a unit dose suited to fit a dose of the active ingredients. Such dosage forms in a unit dose include, for example, tablets, pills, capsules, injections (ampoules), suppositories, etc. The amount of the aforesaid antibody contained is generally about 5 to about 500 mg per dosage form in a unit dose; especially in the form of injection, it is preferred that the aforesaid antibody is contained in about 5 to about 100 mg and in about 10 to about 250 mg for the other dosage forms.

Therapeutic Uses of the Antigen-Binding Molecules

The present invention includes methods comprising administering to a subject in need thereof a therapeutic composition comprising an anti-PSMA antibody or antigen-binding fragment thereof, or a bispecific antigen-binding molecule that specifically binds CD3 and PSMA. The therapeutic composition can comprise any of the antibodies or bispecific antigen-binding molecules as disclosed herein and a pharmaceutically acceptable carrier or diluent. As used herein, the expression "a subject in need thereof" means a human or non-human animal that exhibits one or more symptoms or indicia of cancer (e.g., a subject expressing a tumor or suffering from any of the cancers mentioned herein below), or who otherwise would benefit from an inhibition or reduction in PSMA activity or a depletion of PSMA+ cells (e.g., prostate cancer cells).

The antibodies and bispecific antigen-binding molecules of the invention (and therapeutic compositions comprising the same) are useful, inter alia, for treating any disease or disorder in which stimulation, activation and/or targeting of an immune response would be beneficial. In particular, the anti-PSMA antibodies or the anti-CD3/anti-PSMA bispecific antigen-binding molecules of the present invention may be used for the treatment, prevention and/or amelioration of any disease or disorder associated with or mediated by PSMA expression or activity or the proliferation of PSMA+ cells. The mechanism of action by which the therapeutic methods of the invention are achieved include killing of the cells expressing PSMA in the presence of effector cells, for example, by CDC, apoptosis, ADCC, phagocytosis, or by a combination of two or more of these mechanisms. Cells expressing PSMA which can be inhibited or killed using the bispecific antigen-binding molecules of the invention include, for example, prostate tumor cells.

The antigen-binding molecules of the present invention may be used to treat, e.g., primary and/or metastatic tumors arising in the gastrointestinal tract, prostate, kidney, and/or bladder. In certain embodiments, the bispecific antigen-binding molecules of the invention are used to treat one or more of the following cancers: clear cell renal cell carcinoma, chromophobe renal cell carcinoma, (renal) oncocytoma, (renal) transitional cell carcinoma, prostate cancer, colorectal cancer, gastric cancer, urothelial carcinoma, (bladder) adenocarcinoma, or (bladder) small cell carcinoma. According to certain embodiments of the present invention, the anti-PSMA antibodies or anti-PSMA/anti-CD3 bispecific antibodies are useful for treating a patient afflicted with a castrate-resistant prostate cancer. According to other related embodiments of the invention, methods are provided comprising administering an anti-PSMA antibody or an anti-CD3/anti-PSMA bispecific antigen-binding molecule as disclosed herein to a patient who is afflicted with a castrate-resistant prostate cancer. Analytic/diagnostic methods known in the art, such as tumor scanning, etc., may be used to ascertain whether a patient harbors a tumor that is castrate-resistant.

The present invention also includes methods for treating residual cancer in a subject. As used herein, the term "residual cancer" means the existence or persistence of one or more cancerous cells in a subject following treatment with an anti-cancer therapy.

According to certain aspects, the present invention provides methods for treating a disease or disorder associated with PSMA expression (e.g., prostate cancer) comprising administering one or more of the anti-PSMA or bispecific antigen-binding molecules described elsewhere herein to a subject after the subject has been determined to have prostate cancer (e.g., castrate-resistant prostate cancer). For example, the present invention includes methods for treating prostate cancer comprising administering an anti-PSMA antibody or an anti-CD3/anti-PSMA bispecific antigen-binding molecule to a patient 1 day, 2 days, 3 days, 4 days, 5 days, 6 days, 1 week, 2 weeks, 3 weeks or 4 weeks, 2 months, 4 months, 6 months, 8 months, 1 year, or more after the subject has received hormone therapy (e.g., anti-androgen therapy).

Combination Therapies and Formulations

The present invention provides methods which comprise administering a pharmaceutical composition comprising any of the exemplary antibodies and bispecific antigen-binding molecules described herein in combination with one or more additional therapeutic agents. Exemplary additional therapeutic agents that may be combined with or administered in combination with an antigen-binding molecule of the present invention include, e.g., an EGFR antagonist (e.g., an anti-EGFR antibody [e.g., cetuximab or panitumumab] or small molecule inhibitor of EGFR [e.g., gefitinib or erlotinib]), an antagonist of another EGFR family member such as Her2/ErbB2, ErbB3 or ErbB4 (e.g., anti-ErbB2, anti-ErbB3 or anti-ErbB4 antibody or small molecule inhibitor of ErbB2, ErbB3 or ErbB4 activity), an antagonist of EGFRvIII (e.g., an antibody that specifically binds EGFRvIII), a cMET anagonist (e.g., an anti-cMET antibody), an IGF1R antagonist (e.g., an anti-IGF1R antibody), a B-raf inhibitor (e.g., vemurafenib, sorafenib, GDC-0879, PLX-4720), a PDGFR-$\alpha$ inhibitor (e.g., an anti-PDGFR-$\alpha$ antibody), a PDGFR-$\beta$ inhibitor (e.g., an anti-PDGFR-$\beta$ antibody), a VEGF antagonist (e.g., a VEGF-Trap, see, e.g., U.S. Pat. No. 7,087,411 (also referred to herein as a "VEGF-inhibiting fusion protein"), anti-VEGF antibody (e.g., bevacizumab), a small molecule kinase inhibitor of VEGF receptor (e.g., sunitinib, sorafenib or pazopanib)), a DLL4 antagonist (e.g., an anti-DLL4 antibody disclosed in US 2009/0142354 such as REGN421), an Ang2 antagonist (e.g., an anti-Ang2 antibody disclosed in US 2011/0027286 such as H1H685P), a FOLH1 (PSMA) antagonist, a PRLR antagonist (e.g., an anti-PRLR antibody), a STEAP1 or STEAP2 antagonist (e.g., an anti-STEAP1 antibody or an anti-STEAP2 antibody), a TMPRSS2 antagonist (e.g., an anti-TMPRSS2 antibody), a MSLN antagonist (e.g., an anti-MSLN antibody), a CA9 antagonist (e.g., an anti-CA9 antibody), a uroplakin antagonist (e.g., an anti-uroplakin antibody), etc. Other agents that may be beneficially administered in combination with the antigen-binding molecules of the invention include cytokine inhibitors, including small-molecule cytokine inhibitors and antibodies that bind to cytokines such as IL-1, IL-2, IL-3, IL-4, IL-5, IL-6, IL-8, IL-9, IL-11, IL-12, IL-13, IL-17, IL-18, or to their respective receptors. The pharmaceutical compositions of the present invention (e.g., pharmaceutical compositions comprising an anti-CD3/anti-PSMA bispecific antigen-binding molecule as disclosed herein) may also be administered as part of a therapeutic regimen comprising one or more therapeutic combinations selected from "ICE": ifosfamide (e.g., Ifex®), carboplatin (e.g., Paraplatin®), etoposide (e.g., Etopophos®, Toposar®, VePesid®, VP-16); "DHAP": dexamethasone (e.g., Decadron®), cytarabine (e.g., Cytosar-U®, cytosine arabinoside, ara-C), cisplatin (e.g., Platinol®-AQ); and "ESHAP": etoposide (e.g., Etopophos®, Toposar®, VePesid®, VP-16), methylprednisolone (e.g., Medrol®), high-dose cytarabine, cisplatin (e.g., Platinol®-AQ).

The present invention also includes therapeutic combinations comprising any of the antigen-binding molecules mentioned herein and an inhibitor of one or more of VEGF, Ang2, DLL4, EGFR, ErbB2, ErbB3, ErbB4, EGFRvIII, cMet, IGF1R, B-raf, PDGFR-$\alpha$, PDGFR-$\beta$, FOLH1 (PSMA), PRLR, STEAP1, STEAP2, TMPRSS2, MSLN, CA9, uroplakin, or any of the aforementioned cytokines, wherein the inhibitor is an aptamer, an antisense molecule, a ribozyme, an siRNA, a peptibody, a nanobody or an antibody fragment (e.g., Fab fragment; $F(ab')_2$ fragment; Fd fragment; Fv fragment; scFv; dAb fragment; or other engineered molecules, such as diabodies, triabodies, tetrabodies, minibodies and minimal recognition units). The antigen-binding molecules of the invention may also be administered and/or co-formulated in combination with antivirals, antibiotics, analgesics, corticosteroids and/or NSAIDs. The antigen-binding molecules of the invention may also be administered as part of a treatment regimen that also includes radiation treatment and/or conventional chemotherapy.

The additional therapeutically active component(s) may be administered just prior to, concurrent with, or shortly after the administration of an antigen-binding molecule of the present invention; (for purposes of the present disclosure, such administration regimens are considered the administration of an antigen-binding molecule "in combination with" an additional therapeutically active component).

The present invention includes pharmaceutical compositions in which an antigen-binding molecule of the present invention is co-formulated with one or more of the additional therapeutically active component(s) as described elsewhere herein.

Administration Regimens

According to certain embodiments of the present invention, multiple doses of an antigen-binding molecule (e.g., an anti-PSMA antibody or a bispecific antigen-binding molecule that specifically binds PSMA and CD3) may be administered to a subject over a defined time course. The methods according to this aspect of the invention comprise sequentially administering to a subject multiple doses of an antigen-binding molecule of the invention. As used herein, "sequentially administering" means that each dose of an antigen-binding molecule is administered to the subject at a different point in time, e.g., on different days separated by a predetermined interval (e.g., hours, days, weeks or months). The present invention includes methods which comprise sequentially administering to the patient a single initial dose of an antigen-binding molecule, followed by one or more secondary doses of the antigen-binding molecule, and optionally followed by one or more tertiary doses of the antigen-binding molecule.

The terms "initial dose," "secondary doses," and "tertiary doses," refer to the temporal sequence of administration of the antigen-binding molecule of the invention. Thus, the "initial dose" is the dose which is administered at the beginning of the treatment regimen (also referred to as the "baseline dose"); the "secondary doses" are the doses which are administered after the initial dose; and the "tertiary doses" are the doses which are administered after the secondary doses. The initial, secondary, and tertiary doses may all contain the same amount of the antigen-binding molecule, but generally may differ from one another in terms of frequency of administration. In certain embodiments, however, the amount of an antigen-binding molecule contained in the initial, secondary and/or tertiary doses varies from one another (e.g., adjusted up or down as appropriate) during the course of treatment. In certain embodiments, two or more (e.g., 2, 3, 4, or 5) doses are administered at the beginning of the treatment regimen as "loading doses" followed by subsequent doses that are administered on a less frequent basis (e.g., "maintenance doses").

In one exemplary embodiment of the present invention, each secondary and/or tertiary dose is administered 1 to 26 (e.g., 1, 1½, 2, 2½, 3, 3½, 4, 4½, 5, 5½, 6, 6½, 7, 7½, 8, 8½, 9, 9½, 10, 10½, 11, 11½, 12, 12½, 13, 13½, 14, 14½, 15, 15½, 16, 16½, 17, 17½, 18, 18½, 19, 19½, 20, 20½, 21, 21½, 22, 22½, 23, 23½, 24, 24½, 25, 25½, 26, 26½, or more) weeks after the immediately preceding dose. The phrase "the immediately preceding dose," as used herein, means, in a sequence of multiple administrations, the dose of antigen-binding molecule which is administered to a patient prior to the administration of the very next dose in the sequence with no intervening doses.

The methods according to this aspect of the invention may comprise administering to a patient any number of secondary and/or tertiary doses of an antigen-binding molecule (e.g., an anti-PSMA antibody or a bispecific antigen-binding molecule that specifically binds PSMA and CD3). For example, in certain embodiments, only a single secondary dose is administered to the patient. In other embodiments, two or more (e.g., 2, 3, 4, 5, 6, 7, 8, or more) secondary doses are administered to the patient. Likewise, in certain embodiments, only a single tertiary dose is administered to the patient. In other embodiments, two or more (e.g., 2, 3, 4, 5, 6, 7, 8, or more) tertiary doses are administered to the patient.

In embodiments involving multiple secondary doses, each secondary dose may be administered at the same frequency as the other secondary doses. For example, each secondary dose may be administered to the patient 1 to 2 weeks after the immediately preceding dose. Similarly, in embodiments involving multiple tertiary doses, each tertiary dose may be administered at the same frequency as the other tertiary doses. For example, each tertiary dose may be administered to the patient 2 to 4 weeks after the immediately preceding dose. Alternatively, the frequency at which the secondary and/or tertiary doses are administered to a patient can vary over the course of the treatment regimen. The frequency of administration may also be adjusted during the course of treatment by a physician depending on the needs of the individual patient following clinical examination.

Diagnostic Uses of the Antibodies

The anti-PSMA antibodies of the present invention may also be used to detect and/or measure PSMA, or PSMA-expressing cells in a sample, e.g., for diagnostic purposes. For example, an anti-PSMA antibody, or fragment thereof, may be used to diagnose a condition or disease characterized by aberrant expression (e.g., over-expression, under-expression, lack of expression, etc.) of PSMA. Exemplary diagnostic assays for PSMA may comprise, e.g., contacting a sample, obtained from a patient, with an anti-PSMA antibody of the invention, wherein the anti-PSMA antibody is labeled with a detectable label or reporter molecule. Alternatively, an unlabeled anti-PSMA antibody can be used in diagnostic applications in combination with a secondary antibody which is itself detectably labeled. The detectable label or reporter molecule can be a radioisotope, such as $^{3}H$, $^{14}C$, $^{32}P$, $^{35}S$, or $^{125}I$; a fluorescent or chemiluminescent moiety such as fluorescein isothiocyanate, or rhodamine; or an enzyme such as alkaline phosphatase, beta-galactosidase, horseradish peroxidase, or luciferase. Another exemplary diagnostic use of the anti-PSMA antibodies of the invention includes $^{89}Zr$-labeled, such as $^{89}Zr$-desferrioxamine-labeled, antibody for the purpose of noninvasive identification and tracking of tumor cells in a subject (e.g. positron emission tomography (PET) imaging). (See, e.g., Tavare, R. et al. Cancer Res. 2016 Jan. 1; 76(1):73-82; and Azad, B B. et al. Oncotarget. 2016 Mar. 15; 7(11):12344-58.) Specific exemplary assays that can be used to detect or measure PSMA in a sample include enzyme-linked immunosorbent assay (ELISA), radioimmunoassay (RIA), and fluorescence-activated cell sorting (FACS).

Samples that can be used in PSMA diagnostic assays according to the present invention include any tissue or fluid sample obtainable from a patient which contains detectable quantities of PSMA protein, or fragments thereof, under normal or pathological conditions. Generally, levels of PSMA in a particular sample obtained from a healthy patient (e.g., a patient not afflicted with a disease or condition associated with abnormal PSMA levels or activity) will be measured to initially establish a baseline, or standard, level of PSMA. This baseline level of PSMA can then be compared against the levels of PSMA measured in samples obtained from individuals suspected of having a PSMA related disease (e.g., a tumor containing PSMA-expressing cells) or condition.

EXAMPLES

The following examples are put forth so as to provide those of ordinary skill in the art with a complete disclosure and description of how to make and use the methods and compositions of the invention, and are not intended to limit the scope of what the inventors regard as their invention. Efforts have been made to ensure accuracy with respect to numbers used (e.g., amounts, temperature, etc.) but some experimental errors and deviations should be accounted for. Unless indicated otherwise, parts are parts by weight, molecular weight is average molecular weight, temperature is in degrees Centigrade, and pressure is at or near atmospheric.

Example 1

Generation of Anti-PSMA Antibodies

Anti-PSMA antibodies were obtained by immunizing a genetically modified mouse with a human PSMA antigen or by immunizing an engineered mouse comprising DNA encoding human immunoglobulin heavy and kappa light chain variable regions with a human PSMA antigen.

Mice were immunized with human prostate cancer cells (LNCaP, ATTC®, Manassas, Va., USA) expressing human PSMA (SEQ ID NO:1651; UniProtKB/Swiss-Prot. No. Q04609). Following immunization, splenocytes were harvested from each mouse and either (1) fused with mouse myeloma cells to preserve their viability and form hybridoma cells and screened for PSMA specificity, or (2) B-cell sorted (as described in US 2007/0280945A1) using a human PSMA with an N-terminal 6-His tag (R&D, Cat#4234-ZN) as the sorting reagent that binds and identifies reactive antibodies (antigen-positive B cells).

Chimeric antibodies to PSMA were initially isolated having a human variable region and a mouse constant region. The antibodies were characterized and selected for desirable characteristics, including affinity, selectivity, etc. If necessary, mouse constant regions were replaced with a desired human constant region, for example wild-type or modified IgG1 or IgG4, to generate a fully human anti-PSMA antibody. While the constant region selected may vary according to specific use, high affinity antigen-binding and target specificity characteristics reside in the variable region. The antibody name designations such as H1H11453N2 and H1M11900N denote fully human antibodies "H1H" or chimeric human variable/mouse constant region antibodies "H1M". Antibodies identified by the hybridoma method are indicated with antibody ID numbers ending with "N" or "N2"; Antibodies identified by the B-cell sorting method are indicated with antibody ID numbers ending with "P" or "P2".

Certain biological properties of the exemplary anti-PSMA antibodies generated in accordance with the methods of this Example are described in detail in the Examples set forth below.

Example 2

Heavy and Light Chain Variable Region Amino Acid and Nucleic Acid Sequences of Anti-PSMA Antibodies Table 1 sets forth the amino acid sequence identifiers of the heavy and light chain variable regions and CDRs of selected anti-PSMA antibodies of the invention. The corresponding nucleic acid sequence identifiers are set forth in Table 2.

TABLE 1

| Amino Acid Sequence Identifiers | | | | | | | | |
|---|---|---|---|---|---|---|---|---|
| Antibody | SEQ ID NOs: | | | | | | | |
| Designation | HCVR | HCDR1 | HCDR2 | HCDR3 | LCVR | LCDR1 | LCDR2 | LCDR3 |
| H1H11453N2 | 2 | 4 | 6 | 8 | 1642 | 1644 | 1646 | 1648 |
| H1H11792P2 | 10 | 12 | 14 | 16 | 1642 | 1644 | 1646 | 1648 |
| H1H11797P2 | 18 | 20 | 22 | 24 | 1642 | 1644 | 1646 | 1648 |
| H1H11800P2 | 26 | 28 | 30 | 32 | 1642 | 1644 | 1646 | 1648 |
| H1H11803P2 | 34 | 36 | 38 | 40 | 1642 | 1644 | 1646 | 1648 |
| H1H11804P2 | 42 | 44 | 46 | 48 | 1642 | 1644 | 1646 | 1648 |
| H1H11805P2 | 50 | 52 | 54 | 56 | 1642 | 1644 | 1646 | 1648 |
| H1H11808P2 | 58 | 60 | 62 | 64 | 1642 | 1644 | 1646 | 1648 |
| H1H11810P2 | 66 | 68 | 70 | 72 | 1642 | 1644 | 1646 | 1648 |
| H1H11835P2 | 74 | 76 | 78 | 80 | 1642 | 1644 | 1646 | 1648 |
| H1H11836P2 | 82 | 84 | 86 | 88 | 1642 | 1644 | 1646 | 1648 |
| H1H11837P2 | 90 | 92 | 94 | 96 | 1642 | 1644 | 1646 | 1648 |
| H1H11838P2 | 98 | 100 | 102 | 104 | 1642 | 1644 | 1646 | 1648 |
| H1H11841P2 | 106 | 108 | 110 | 112 | 1642 | 1644 | 1646 | 1648 |
| H1H11899N2 | 114 | 116 | 118 | 120 | 1642 | 1644 | 1646 | 1648 |
| H1H3465P | 122 | 124 | 126 | 128 | 130 | 132 | 134 | 136 |
| H1M11900N | 138 | 140 | 142 | 144 | 146 | 148 | 150 | 152 |

TABLE 2

| Nucleic Acid Sequence Identifiers | | | | | | | | |
|---|---|---|---|---|---|---|---|---|
| Antibody | SEQ ID NOs: | | | | | | | |
| Designation | HCVR | HCDR1 | HCDR2 | HCDR3 | LCVR | LCDR1 | LCDR2 | LCDR3 |
| H1H11453N2 | 1 | 3 | 5 | 7 | 1641 | 1643 | 1645 | 1647 |
| H1H11792P2 | 9 | 11 | 13 | 15 | 1641 | 1643 | 1645 | 1647 |
| H1H11797P2 | 17 | 19 | 21 | 23 | 1641 | 1643 | 1645 | 1647 |
| H1H11800P2 | 25 | 27 | 29 | 31 | 1641 | 1643 | 1645 | 1647 |
| H1H11803P2 | 33 | 35 | 37 | 39 | 1641 | 1643 | 1645 | 1647 |
| H1H11804P2 | 41 | 43 | 45 | 47 | 1641 | 1643 | 1645 | 1647 |
| H1H11805P2 | 49 | 51 | 53 | 55 | 1641 | 1643 | 1645 | 1647 |
| H1H11808P2 | 57 | 59 | 61 | 63 | 1641 | 1643 | 1645 | 1647 |
| H1H11810P2 | 65 | 67 | 69 | 71 | 1641 | 1643 | 1645 | 1647 |
| H1H11835P2 | 73 | 75 | 77 | 79 | 1641 | 1643 | 1645 | 1647 |
| H1H11836P2 | 81 | 83 | 85 | 87 | 1641 | 1643 | 1645 | 1647 |

TABLE 2-continued

| Nucleic Acid Sequence Identifiers | | | | | | | | |
|---|---|---|---|---|---|---|---|---|
| Antibody | SEQ ID NOs: | | | | | | | |
| Designation | HCVR | HCDR1 | HCDR2 | HCDR3 | LCVR | LCDR1 | LCDR2 | LCDR3 |
| H1H11837P2 | 89 | 91 | 93 | 95 | 1641 | 1643 | 1645 | 1647 |
| H1H11838P2 | 97 | 99 | 101 | 103 | 1641 | 1643 | 1645 | 1647 |
| H1H11841P2 | 105 | 107 | 109 | 111 | 1641 | 1643 | 1645 | 1647 |
| H1H11899N2 | 113 | 115 | 117 | 119 | 1641 | 1643 | 1645 | 1647 |
| H1H3465P | 121 | 123 | 125 | 127 | 129 | 131 | 133 | 135 |
| H1M11900N | 137 | 139 | 141 | 143 | 145 | 147 | 149 | 151 |

Example 3

Surface Plasmon Resonance Derived Binding Affinities and Kinetic Constants of Human Monoclonal Anti-PSMA Antibodies In this example, anti-PSMA antibodies were assessed for their ability to bind to human PSMA. Binding affinities and kinetic constants of anti-PSMA antibodies to soluble human PSMA protein were determined by surface plasmon resonance at 37° C. using an antibody-capture format. Results are shown in Tables 3 and 4. Measurements were conducted on a Biacore™ T-200 instrument (GE Healthcare).

Briefly, a CM5 Biacore™ sensor surface was derivatized via amine coupling with a monoclonal mouse anti-human Fc antibody (GE, #BR-1008-39) or monoclonal goat anti-mouse Fc antibody (GE, #BR-1008-38) to capture purified anti-PSMA antibodies. Binding studies were performed in HBSP++ buffer composed of 0.01M HEPES, 0.15M NaCl, 2 mM $Ca^{2+}$, 2 mM $Mg^{2+}$, 0.05% v/v Surfactant P20, pH7.4. Varying concentrations of human PSMA expressed with an N-terminal hexahistidine tag (6h.hPSMA, R&D) prepared in HBSP++ running buffer (ranging from 50 to 0.78 nM, 4-fold dilutions) were injected over the anti-PSMA antibody captured surface at a flow rate of 30 μL/minute. Antibody-reagent association was monitored for 2 minutes while dissociation in HBSP++ running buffer was monitored for 8 minutes.

Kinetic association ($k_a$) and dissociation ($k_d$) rate constants were determined by fitting the real-time sensorgrams to a 1:1 binding model using Scrubber 2.0c curve fitting software. Binding dissociation equilibrium constants ($K_D$) and dissociative half-lives (t½) were calculated from the kinetic rate constants as: $K_D$ (M)=$k_d/k_a$; and $t_{1/2}$ (min)=(ln 2/(60*$k_d$).

As shown in Tables 3 and 4, the anti-PSMA antibodies of the invention bound to human PSMA in the antibody capture format with varying affinities and $K_D$ values ranging from 19.9 pM to 75.6 nM. Several exemplary anti-PSMA antibodies, such as H1H3465P and H1H11810P2, displayed strong affinity to human PSMA protein, with sub-nanomolar $K_D$ values.

TABLE 3

Affinities of anti-PSMA human IgG1 antibodies to soluble human PSMA at 37° C.

| Antibody ID | ka (1/Ms) | kd (1/s) | KD (M) | $t_{1/2}$ (min) |
|---|---|---|---|---|
| H1H3465P | 2.67E+05 | 6.06E−05 | 2.27E−10 | 190.6 |
| H1H11792P2 | 4.73E+05 | 9.70E−05 | 2.05E−10 | 119.1 |
| H1H11797P2 | 1.68E+05 | 6.30E−04 | 3.74E−09 | 18.3 |
| H1H11800P2 | 2.51E+05 | 4.10E−05 | 1.63E−10 | 281.8 |
| H1H11803P2 | 4.57E+05 | 6.08E−04 | 1.33E−09 | 19 |
| H1H11804P2 | 2.03E+04 | 8.01E−04 | 3.94E−08 | 14.4 |

TABLE 3-continued

Affinities of anti-PSMA human IgG1 antibodies to soluble human PSMA at 37° C.

| Antibody ID | ka (1/Ms) | kd (1/s) | KD (M) | $t_{1/2}$ (min) |
|---|---|---|---|---|
| H1H11805P2 | 1.29E+05 | 9.74E−03 | 7.56E−08 | 1.2 |
| H1H11808P2 | 1.78E+05 | ≤1E−05 | ≤5.63E−11 | ≥1155 |
| H1H11810P2 | 5.03E+05 | ≤1E−05 | ≤1.99E−11 | ≥1155 |
| H1H11835P2 | 1.75E+05 | 2.46E−03 | 1.40E−08 | 4.7 |
| H1H11836P2 | 3.27E+05 | 2.80E−04 | 8.55E−10 | 41.3 |
| H1H11837P2 | 4.41E+05 | 7.34E−04 | 1.66E−09 | 15.7 |
| H1H11838P2 | 2.37E+05 | 4.71E−04 | 1.99E−09 | 24.5 |
| H1H11841P2 | IC | IC | IC | IC |

IC: inconclusive

TABLE 4

Affinities of anti-PSMA mouse constant antibodies to soluble human PSMA at 37° C.

| Antibody ID | ka (1/Ms) | kd (1/s) | KD (M) | $t_{1/2}$ (min) |
|---|---|---|---|---|
| H2M11899N | 1.51E+05 | 2.65E−04 | 1.76E−09 | 43.6 |
| H1M11453N | 1.85E+05 | 3.56E−04 | 1.93E−09 | 32.4 |
| H1M11900N | 1.57E+05 | 4.06E−03 | 2.58E−08 | 2.8 |

Example 4

Generation of Bispecific Antibodies that Bind Prostate-Specific Membrane Antigen (PSMA) and CD3

The present invention provides bispecific antigen-binding molecules that bind CD3 and Prostate-Specific Membrane Antigen (PSMA); such bispecific antigen-binding molecules are also referred to herein as "anti-PSMA/anti-CD3 bispecific molecules." The anti-PSMA portion of the anti-PSMA/anti-CD3 bispecific molecule is useful for targeting tumor cells that express PSMA, and the anti-CD3 portion of the bispecific molecule is useful for activating T-cells. The simultaneous binding of PSMA on a tumor cell and CD3 on a T-cell facilitates directed killing (cell lysis) of the targeted tumor cell by the activated T-cell.

Bispecific antibodies comprising an anti-PSMA-specific binding domain and an anti-CD3-specific binding domain were constructed using standard methodologies, wherein the anti-PSMA antigen binding domain and the anti-CD3 antigen binding domain each comprise different, distinct HCVRs paired with a common LCVR. In some instances the bispecific antibodies were constructed utilizing a heavy chain from an anti-CD3 antibody, a heavy chain from an anti-PSMA antibody and a common light chain In other instances, the bispecific antibodies were constructed utilizing a heavy chain from an anti-CD3 antibody, a heavy chain from an anti-PSMA antibody and a light chain from an anti-CD3 antibody.

The bispecific antibodies described in the following examples consist of binding arms known to bind to human soluble heterodimeric hCD3ε/δ protein (as described in Examples 9-13 herein); and human PSMA (see Examples 1-3 above). Exemplified bispecific antibodies were manufactured having a modified (chimeric) IgG4 Fc domain as set forth in US Patent Application Publication No. US20140243504A1, published on Aug. 28, 2014.

A summary of the component parts of the antigen-binding domains of the various anti-PSMA×CD3 bispecific antibodies constructed is set forth in Table 5.

TABLE 5

Summary of Component Parts of PSMAxCD3 Bispecific Antibodies

| Bispecific Antibody Identifier | Anti-PSMA Antigen-Binding Domain Heavy Chain Variable Region | Anti-CD3 Antigen-Binding Domain Heavy Chain Variable Region | Common Light Chain Variable Region |
|---|---|---|---|
| BSPSMA/CD3-001 | PSMA-VH-3465 | CD3-VH-A | CD3-VL-A |
| BSPSMA/CD3-002 | PSMA-VH-3465 | CD3-VH-B | CD3-VL-B |
| BSPSMA/CD3-003 | PSMA-VH-11810 | CD3-VH-G | VK 1-39 JK 5 (SEQ ID NO: 1642) |
| BSPSMA/CD3-200 | PSMA-VH-11810 | CD3-VH-G2 | VK 1-39 JK 5 (SEQ ID NO: 1642) |
| BSPSMA/CD3-300 | PSMA-VH-11810 | CD3-VH-G3 | VK 1-39 JK 5 (SEQ ID NO: 1642) |
| BSPSMA/CD3-400 | PSMA-VH-11810 | CD3-VH-G4 | VK 1-39 JK 5 (SEQ ID NO: 1642) |
| BSPSMA/CD3-004 | PSMA-VH-11810 | CD3-VH-G5 | VK 1-39 JK 5 (SEQ ID NO: 1642) |
| BSPSMA/CD3-800 | PSMA-VH-11810 | CD3-VH-G8 | VK 1-39 JK 5 (SEQ ID NO: 1642) |
| BSPSMA/CD3-900 | PSMA-VH-11810 | CD3-VH-G9 | VK 1-39 JK 5 (SEQ ID NO: 1642) |
| BSPSMA/CD3-1000 | PSMA-VH-11810 | CD3-VH-G10 | VK 1-39 JK 5 (SEQ ID NO: 1642) |
| BSPSMA/CD3-1100 | PSMA-VH-11810 | CD3-VH-G11 | VK 1-39 JK 5 (SEQ ID NO: 1642) |
| BSPSMA/CD3-1200 | PSMA-VH-11810 | CD3-VH-G12 | VK 1-39 JK 5 (SEQ ID NO: 1642) |
| BSPSMA/CD3-1300 | PSMA-VH-11810 | CD3-VH-G13 | VK 1-39 JK 5 (SEQ ID NO: 1642) |
| BSPSMA/CD3-1400 | PSMA-VH-11810 | CD3-VH-G14 | VK 1-39 JK 5 (SEQ ID NO: 1642) |
| BSPSMA/CD3-1500 | PSMA-VH-11810 | CD3-VH-G15 | VK 1-39 JK 5 (SEQ ID NO: 1642) |
| BSPSMA/CD3-1600 | PSMA-VH-11810 | CD3-VH-G16 | VK 1-39 JK 5 (SEQ ID NO: 1642) |
| BSPSMA/CD3-1700 | PSMA-VH-11810 | CD3-VH-G17 | VK 1-39 JK 5 (SEQ ID NO: 1642) |
| BSPSMA/CD3-1800 | PSMA-VH-11810 | CD3-VH-G18 | VK 1-39 JK 5 (SEQ ID NO: 1642) |
| BSPSMA/CD3-1900 | PSMA-VH-11810 | CD3-VH-G19 | VK 1-39 JK 5 (SEQ ID NO: 1642) |
| BSPSMA/CD3-005 | PSMA-VH-11810 | CD3-VH-G20 | VK 1-39 JK 5 (SEQ ID NO: 1642) |

TABLE 5-continued

Summary of Component Parts of PSMAxCD3 Bispecific Antibodies

| Bispecific Antibody Identifier | Anti-PSMA Antigen-Binding Domain Heavy Chain Variable Region | Anti-CD3 Antigen-Binding Domain Heavy Chain Variable Region | Common Light Chain Variable Region |
|---|---|---|---|
| BSPSMA/CD3-2100 | PSMA-VH-11810 | CD3-VH-G21 | VK 1-39 JK 5 (SEQ ID NO: 1642) |

The anti-PSMA heavy chain variable region PSMA-VH-3465 is the HCVR of H1H3465P (SEQ ID NO:122) from Table 1. The anti-PSMA heavy chain variable region PSMA-VH-11810 is the HCVR of H1H11810P2 (SEQ ID NO:66) from Table 1.

The anti-CD3 heavy chain variable region CD3-VH-A is the HCVR of H1H5778P (SEQ ID NO:922) from Table 12. The anti-CD3 heavy chain variable region CD3-VH-B is the HCVR of H1H2712N (SEQ ID NO:154) from Table 12. The anti-CD3 heavy chain variable regions CD3-VH-G, CD3-VH-G2, CD3-VH-G3, CD3-VH-G4, CD3-VH-G5, CD3-VH-G8, CD3-VH-G9, CD3-VH-G10, CD3-VH-G11, CD3-VH-G12, CD3-VH-G13, CD3-VH-G14, CD3-VH-G15, CD3-VH-G16, CD3-VH-G17, CD3-VH-G18, CD3-VH-G19, CD3-VH-G20, and CD3-VH-G21 are described in Table 18.

The light chains in Table 5 were common to both the CD3 and PSMA targeting arms of the bispecific antibodies. The anti-CD3 light chain variable region CD3-VL-A is the LCVR of H1H5778P (SEQ ID NO:930) from Table 12. The anti-CD3 light chain variable region CD3-VL-B is the LCVR of H1H2712N (SEQ ID NO:162) from Table 12. The light chain variable region VK 1-39 JK 5 is SEQ ID NO: 1642 from Table 20. Table 1 sets out amino acid sequence identifiers for the various heavy chain variable regions, and their corresponding CDRs, of the anti-PSMA arms of the bispecific antibodies of this Example. Table 2 sets out the sequence identifiers for the nucleotide sequences encoding the heavy chain variable regions, and their corresponding CDRs, of the anti-PSMA antigen-binding domains of the bispecific antibodies of this Example.

Tables 12, 14, 15, 18, and 20 describe amino acid sequences of the heavy chain variable regions, and their corresponding CDRs, for the anti-CD3 arms of the bispecific antibodies, as well as amino acid sequences for the light chain variable regions, and their corresponding CDRs, common to both arms of the bispecific antibodies of this Example. Tables 13, 16, 17, 19, and 21 describe the corresponding nucleotide sequences for these features of the bispecific antibodies of this Example.

Example 5

Binding Affinities of Exemplified Bispecific Antibodies as Measured by FACS Analysis In this example, the ability of the anti-PSMA/anti-CD3 bispecific antibodies described in Example 4 to bind to human PSMA expressing cell lines and to human and cynomolgus CD3-expressing cell lines via FACS was determined. As described above, the bispecific antibodies of this invention utilized a PSMA-specific heavy chain (HC) binding arm paired with a panel of anti-CD3 HC binding arms and a common light chain. The PSMA-HC binding arms in the bispecific antibodies, below, demonstrated potent binding to human PSMA protein via surface plasmon resonance (Example 3). As described in Examples 6 and 13 herein, the CD3-binding HC arms also displayed a range of affinities to human soluble heterodimeric hCD3ε/δ.mFc protein via surface plasmon resonance.

Briefly, $2\times10^5$ cells/well of human CD3-expressing Jurkat, cynomolgus T, or human PSMA-specific expressing cells were incubated with a serial dilution of bispecific antibodies for 30 min at 4° C. After incubation, cells were washed and a goat $F(ab')_2$ anti-human Fcγ PE labeled secondary (Jackson Immunolabs) was added to the cells for an additional 30 min. Next, cells were washed, re-suspended in cold PBS+1% BSA and analyzed via flow cytometry on a BD FACS Canto II.

For FACS analysis, cells were gated by forward scatter height vs. forward scatter area for single events selection, followed by side and forward scatters. The $EC_{50}$ for cell binding titration was determined using Prism software. Values were calculated using 4-parameter non-linear regression analysis.

TABLE 6

FACS Binding on CD3 and PSMA-Specific Cell lines

| Bispecific Antibody Identifier | Anti-CD3-Binding Arm | Jurkat $EC_{50}$ [M] | Cyno T-cells $EC_{50}$ [M] | B16F10.9/PSMA $EC_{50}$ [M] | 22RV1 $EC_{50}$ [M] |
|---|---|---|---|---|---|
| BSPSMA/CD3-001 | CD3-VH-A | 3.91E−08 | NT | NT | 7.85E−08 |
| BSPSMA/CD3-002 | CD3-VH-B | NT | NT | NT | NT |
| BSPSMA/CD3-003 | CD3-VH-G | 1.65E−08 | 1.42E−08 | 2.26E−09 | NT |
| BSPSMA/CD3-200 | CD3-VH-G2 | NB | NB | 1.88E−09 | NT |
| BSPSMA/CD3-300 | CD3-VH-G3 | NB | NB | 1.90E−09 | NT |
| BSPSMA/CD3-400 | CD3-VH-G4 | NB | NB | 1.72E−09 | NT |
| BSPSMA/CD3-004 | CD3-VH-G5 | ~1.0E−06 | NB | 1.31E−09 | NT |
| BSPSMA/CD3-800 | CD3-VH-G8 | 1.93E−08 | 1.96E−08 | 1.31E−09 | NT |
| BSPSMA/CD3-900 | CD3-VH-G9 | 2.74E−07 | NB | 1.43E−09 | NT |
| BSPSMA/CD3-1000 | CD3-VH-G10 | 2.77E−07 | NB | 1.19E−09 | NT |
| BSPSMA/CD3-1100 | CD3-VH-G11 | 1.83E−08 | 8.90E−07 | 1.03E−09 | NT |
| BSPSMA/CD3-1200 | CD3-VH-G12 | 4.72E−08 | NB | 1.16E−09 | NT |
| BSPSMA/CD3-1300 | CD3-VH-G13 | 1.02E−07 | 2.17E−06 | 1.25E−09 | NT |
| BSPSMA/CD3-1400 | CD3-VH-G14 | 3.19E−08 | 1.70E−07 | 1.30E−09 | NT |
| BSPSMA/CD3-1500 | CD3-VH-G15 | 9.30E−08 | NB | 1.21E−09 | NT |
| BSPSMA/CD3-1600 | CD3-VH-G16 | 5.68E−08 | NB | 1.03E−09 | NT |
| BSPSMA/CD3-1700 | CD3-VH-G17 | 2.00E−07 | 3.35E−06 | 1.34E−09 | NT |
| BSPSMA/CD3-1800 | CD3-VH-G18 | 1.26E−07 | NB | 2.16E−09 | NT |
| BSPSMA/CD3-1900 | CD3-VH-G19 | 6.07E−08 | NB | 1.35E−09 | NT |
| BSPSMA/CD3-005 | CD3-VH-G20 | 2.10E−07 | 6.14E−06 | 2.09E−09 | NT |
| BSPSMA/CD3-2100 | CD3-VH-G21 | 1.06E−07 | NB | 1.14E−09 | NT |

NB = no binding;
NT = not tested

As shown in Table 6, the anti-PSMA/anti-CD3 bispecific antibodies tested demonstrated specificity of binding to human PSMA-expressing B16F10.9/hPSMA and 22RV1 cell lines via FACS. The detection limit for FACS binding is 1 μM EC50.

As shown in Table 6, the CD3 binding arms of each CD3×PSMA bispecific antibody displayed a range of cell binding affinity to human CD3 expressing Jurkat cells (15 to 300 nM EC50 range). Importantly, the CD3 arms that showed weak-to-no binding to human CD3 heterodimeric protein via surface plasmon resonance (see Table 7 hereinbelow) also correlated with weak to no observable binding on Jurkat cells (i.e. CD3-VH-G2, CD3-VH-G3, CD3-VH-G5). Several CD3-binding arms also displayed cross reactivity to cynomolgus T-cells. All tested bispecific antibodies displayed similar cell binding on respective PSMA-expressing cell lines, confirming that bispecific pairing with individual CD3 arms did not affect or diminish PSMA-specific binding (PSMA-specific binding was less than or equal to 5.6 nM (high affinity) in all examples tested).

Antibodies exhibiting weak-to-no detectable binding to human CD3, and also exhibiting weak-to-no binding to cynomolgus CD3, were considered advantageous for avidity-driven bispecific pairing in accordance with the present invention, and were further tested for cytotoxicity in in vitro and in vivo assays.

Example 6

Binding Affinities of Exemplified Antibodies as Measured by a Surface Plasmon Resonance Binding Assay Binding affinities and kinetic constants of anti-PSMA× anti-CD3 bispecific antibodies to soluble heterodimeric hCD3ε/δ.mFc protein (hCD3ε=UniProtKB/Swiss-Prot: P07766.2; SEQ ID NO: 1652; hCD3δ=Uni ProtKB/Swiss-Prot: P04234.1, SEQ ID NO: 1653) were determined by surface plasmon resonance at 37° C. using an antigen-capture format (Table 7). Measurements were conducted on a Sierra Sensors MASS-1 instrument.

In the antigen-capture format, the MASS-1 high-density amine sensor surface was derivatized with a goat anti-mouse IgG2a polyclonal antibody (Southern Biotech). Soluble heterodimeric CD3 protein was captured and the respective antibodies were injected over the captured antigen.

Kinetic association ($k_a$) and dissociation ($k_d$) rate constants were determined by processing and fitting the data to a 1:1 binding model using MASS-1 AnalyserR2 curve fitting software. Binding dissociation equilibrium constants ($K_D$) and dissociative half-lives ($t_{1/2}$) were calculated from the kinetic rate constants as: $K_D$ (M)=$k_d/k_a$; and $t_{1/2}$ (min)=(ln 2/(60*$k_d$).

TABLE 7

Affinities of anti-CD3 Bispecific Antibodies to Soluble Human CD3

| Bispecific Antibody Identifier | Corresponding anti-CD3 Antigen-Binding HCVR Identifier | Binding at 37° C./Antigen-Capture Format ka ($Ms^{-1}$) | kd ($s^{-1}$) | $K_D$ (M) | T½ (min) |
|---|---|---|---|---|---|
| BSPSMA/CD3-003 | CD3-VH-G | 1.32E+05 | 7.62E−04 | 5.78E−09 | 15.2 |
| BSPSMA/CD3-200 | CD3-VH-G2 | NB | NB | NB | NB |
| BSPSMA/CD3-300 | CD3-VH-G3 | NB | NB | NB | NB |
| BSPSMA/CD3-400 | CD3-VH-G4 | NB | NB | NB | NB |
| BSPSMA/CD3-004 | CD3-VH-G5 | NB | NB | NB | NB |
| BSPSMA/CD3-800 | CD3-VH-G8 | 5.95E+04 | 1.15E−03 | 1.94E−08 | 10.0 |
| BSPSMA/CD3-900 | CD3-VH-G9 | 4.38E+04 | 4.95E−03 | 1.13E−07 | 2.3 |
| BSPSMA/CD3-1000 | CD3-VH-G10 | 3.44E+04 | 6.37E−03 | 1.85E−07 | 1.8 |
| BSPSMA/CD3-1100 | CD3-VH-G11 | 9.21E+04 | 1.02E−03 | 1.11E−08 | 11.3 |
| BSPSMA/CD3-1200 | CD3-VH-G12 | 3.85E+04 | 2.47E−03 | 6.42E−08 | 4.7 |
| BSPSMA/CD3-1300 | CD3-VH-G13 | 2.03E+04 | 2.48E−03 | 1.22E−07 | 4.7 |
| BSPSMA/CD3-1400 | CD3-VH-G14 | 6.21E+04 | 3.31E−03 | 5.33E−08 | 3.5 |
| BSPSMA/CD3-1500 | CD3-VH-G15 | 7.36E+04 | 6.11E−03 | 8.29E−08 | 1.9 |
| BSPSMA/CD3-1600 | CD3-VH-G16 | 6.43E+04 | 2.43E−03 | 3.78E−08 | 4.7 |
| BSPSMA/CD3-1700 | CD3-VH-G17 | 4.70E+04 | 3.07E−03 | 6.52E−08 | 3.8 |
| BSPSMA/CD3-1800 | CD3-VH-G18 | NB | NB | NB | NB |
| BSPSMA/CD3-1900 | CD3-VH-G19 | 4.43E+04 | 5.09E−03 | 1.15E−07 | 2.3 |
| BSPSMA/CD3-005 | CD3-VH-G20 | 1.73E+04 | 5.77E−03 | 3.34E−07 | 2.0 |
| BSPSMA/CD3-2100 | CD3-VH-G21 | 3.02E+04 | 2.34E−03 | 7.75E−08 | 4.9 |
| Control 1 | CD3-L2K | 3.68E+05 | 2.66E−03 | 7.22E−09 | 4.3 |

As shown in Table 7, the anti-CD3×anti-PSMA bispecific antibodies either maintained very weak binding to soluble CD3 in the surface plasmon resonance binding assay, e.g. having a $K_D$ value greater than 11 nM up to 334 nM which is weaker than that of the bispecific anti-CD3 arm derived from germline frameworks, CD3-VH-G, or did not exhibit any detectable binding.

As such, several bispecific antibodies exhibited greater than 50 nM KD values, and some were greater than 100 nM (i.e. BSPSMA/CD3-900, BSPSMA/CD3-1000, BSPSMA/CD3-1900, BSPSMA/CD3-005) and even beyond the detection limit of the assay, i.e. showed no detectable binding to soluble human CD3 (i.e. BSPSMA/CD3-200, BSPSMA/CD3-300, BSPSMA/CD3-400, BSPSMA/CD3-004 and BSPSMA/CD3-1800).

Example 7

T Cell Activation and Tumor-specific Cytotoxicity Exhibited by Bispecific Antibodies of the Invention as Measured In Vitro In this example, the specific killing of PSMA-expressing target cells in the presence of anti-PSMA×anti-CD3 bispecific antibodies was monitored via flow cytometry. As reported previously, the bispecific antibodies displayed a range of affinity to CD3 protein and CD3-expressing cell lines (i.e. weak, moderate and strong binding). This same panel of bispecific antibodies was tested for the ability to induce naïve human T-cells to re-direct killing toward target-expressing cells.

Briefly, PSMA-expressing (C4-2, 22Rv1 and TRAMPC2_PSMA) cell lines were labeled with 1 μM of the fluorescent tracking dye Violet Cell Tracker. After labeling, cells were plated overnight at 37° C. Separately, human PBMCs were plated in supplemented RPMI media at $1\times10^6$ cells/mL and incubated overnight at 37° C. in order to enrich for lymphocytes by depleting adherent macrophages, dendritic cells, and some monocytes. The next day, target cells were co-incubated with adherent cell-depleted naïve PBMC (Effector/Target cell 4:1 ratio) and a serial dilution of relevant bispecific antibodies or Isotype control (concentration range: 66.7 nM to 0.25 pM) for 48 hours at 37° C. Cells were removed from cell culture plates using an enzyme-free cell dissociation buffer, and analyzed by FACS.

For FACS analysis, cells were stained with a dead/live far red cell tracker (Invitrogen). $5\times10^5$ counting beads were added to each well immediately before FACS analysis. $1\times10^4$ beads were collected for each sample. For the assessment of specificity of killing, cells were gated on live Violet labeled populations. Percent of live population was recorded and used for the calculation of normalized survival.

T cell activation was assessed by incubating cells with directly conjugated antibodies to CD2 and CD69, and by reporting the percent of activated (CD69+) T cells out of total T cells (CD2+).

As the results in Table 8 show, depletion of PSMA-expressing cells was observed with anti-PSMA×anti-CD3 bispecific antibodies. Most of the tested bispecific antibodies activated and directed human T cells to deplete the target cells with $EC_{50}$s in picomolar range. Additionally, the observed target-cell lysis was associated with an up-regulation of CD69 cells on CD2+ T cells, with pM $EC_{50}$s.

Importantly, the results of this example demonstrate that several bispecifics which utilized a CD3 binding arm that displayed weak-to-non-observable binding to CD3 protein or CD3-expressing cells (i.e. CD3-VH-G5) still retained the ability to activate T-cells and exhibited potent cytotoxicity of tumor antigen-expressing cells.

TABLE 8

Cytotoxicity and T-cell activation properties of selected PSMAxCD3 Bispecific Antibodies

| Bispecific Antibody Identifier | Anti-CD3 Binding Arm | C4-2 Cell depletion $EC_{50}$ [M] | 22RV1 Cell depletion $EC_{50}$ [M] | TrampC2.PSMA Cell depletion $EC_{50}$ [M] | T cell activation $EC_{50}$ [M] |
|---|---|---|---|---|---|
| BSPSMA/CD3-003 | CD3-VH-G | 1.03E−11 | NT | 6.43E−12 | 1.23E−12 |
| BSPSMA/CD3-200 | CD3-VH-G2 | NT | No activity | NT | No activity |
| BSPSMA/CD3-300 | CD3-VH-G3 | NT | Very weak | NT | 1.85E−11 |
| BSPSMA/CD3-400 | CD3-VH-G4 | NT | Very weak | NT | Very weak |
| BSPSMA/CD3-004 | CD3-VH-G5 | 2.15E−11 | 6.31E−12 | 1.15E−11 | 1.34E−11 |
| BSPSMA/CD3-800 | CD3-VH-G8 | NT | NT | 9.27E−12 | 1.76E−12 |
| BSPSMA/CD3-900 | CD3-VH-G9 | NT | NT | 3.50E−12 | 1.12E−12 |
| BSPSMA/CD3-1000 | CD3-VH-G10 | NT | NT | 5.97E−12 | 1.28E−12 |
| BSPSMA/CD3-1100 | CD3-VH-G11 | NT | NT | 3.86E−12 | 1.11E−12 |
| BSPSMA/CD3-1300 | CD3-VH-G13 | 8.74E−12 | NT | NT | 2.31E−12 |
| BSPSMA/CD3-1700 | CD3-VH-G17 | 7.37E−12 | 2.07E−12 | NT | 3.89E−12 |
| BSPSMA/CD3-005 | CD3-VH-G20 | 1.39E−11 | 8.32E−12 | NT | 6.11E−12 |

NT = not tested

Example 8

Anti-PSMA/Anti-CD3 Bispecific Antibodies Display Potent Anti-tumor Efficacy In Vivo To determine the in vivo efficacy of exemplary anti-PSMA/anti-CD3 bispecific antibodies, studies were performed in immunocompromised mice bearing human prostate cancer xenografts. Additional studies were also carried out in immunocompetent mice bearing mouse prostate cancer xenografts engineered to express human PSMA.

Efficacy of Anti-PSMA/Anti-CD3 Bispecific Antibodies in Human Tumor Xenograft Models To assess the in vivo efficacy of the anti-PSMA/anti-CD3 bispecifics in human tumor xenograft studies, NOD scid gamma (NSG) mice (Jackson Laboratories, Bar Harbor, Me.) were co-implanted with human peripheral blood mononuclear cells (PBMCs) along with 22Rv1 or C4-2 human prostate tumor cells which endogenously express PSMA.

Briefly, $4\times10^6$ 22 Rv1 or $5\times10^6$ C4-2 cells (MD Anderson, Tex.) cells were co-implanted s.c. with $1\times10^6$ human PBMCs (ReachBio, LLC., Seattle, Wash.) in a 50:50 mix of matrigel matrix (BD Biosciences) into the right flank of male NSG mice. In the 22Rv1 study, mice were treated i.p. on days 0, 3 and 7 with 1 ug of BSPSMA/CD3-001 or an isotype control (FIG. 1). In the C4-2 study, mice were treated i.p. on days 0, 4, and 7 post tumor implantation with 0.1 mg/kg BSPSMA/CD3-001, BSPSMA/CD3-003 or BSPSMA/CD3-005.

In an additional xenogenic model, anti-PSMA/anti-CD3 bispecifics were tested in mice engrafted with human hematopoietic CD34+ stem cells. Briefly, newborn SIRPα BALB/c-Rag2− IL2rγ− (BRG) pups were engrafted with hCD34+ fetal liver cells. 3-6 months later hCD34-engrafted SIRPa BRG mice were then implanted with C4-2 cells ($5\times10^6$ s.c. in matrigel). 8 days later, mice were treated with 10 ug of BSPSMA/CD3-004 or an isotype control antibody, followed by 2×/week doses throughout the study.

In all studies, tumor size was measured 2×/week using calipers and tumor volume calculated as Volume=$(\text{length}\times \text{width}^2)^2$.

As the results in Table 9 show, the bispecific antibodies tested in the xenogenic models described above were all effective at inhibiting tumor growth compared to treatment with the isotype control.

Efficacy of Anti-PSMA/Anti-CD3 Bispecific Antibodies in Established Human Tumor Xenograft Model Next, the efficacy of anti-PSMA/anti-CD3 bispecific antibodies in suppressing the growth of established tumors was assessed. NSG mice were first injected with $2.5\times10^6$ human PBMCs i.p. to allow for engraftment of human T cells. Fourteen days later, mice were co-implanted with C4-2 cells and PBMCs as above. 20 ug of BSPSMA/CD3-002 or an isotype control were administered i.p. 18 days post tumor implantation and continued 2×/week for the duration of the study. Additional PBMCs were given i.p. on days 20 and 40 post tumor implantation.

As the results in Table 9 show, BSPSMA/CD3-002 showed efficacy in suppressing the growth of established tumors, decreasing tumor growth by 95%.

Efficacy of Anti-PSMA/Anti-CD3 Bispecific Antibodies in Immune-competent Tumor Model Additionally, anti-PSMA/anti-CD3 bispecifics were assessed for anti-tumor activity in an immune-competent model. Mice humanized for the three chains (δγε) of CD3 as well as for PSMA were implanted with a variant murine prostate cancer cell line TRAMP-C2 transfected with human PSMA.

Prior to study initiation, the tumorigenic cell line variant TRAMP-C2_hPSMAv#1 was generated. Briefly, $7.5\times10^6$ TRAMP-C2_hPSMA cells were implanted s.c. into the right flank of male mice humanized for CD3 and PSMA. A tumor was excised and cut into 3 mm fragments and subsequently implanted into the right flank of new male humanized mice. A tumor arising from the implanted tumor fragments was then harvested and disaggregated into a single cell suspension. These cells (TRAMP-C2_hPSMAv#1) were then cultured in vitro under G418 selection. $4\cdot10^6$ cells of this variant cell line were then implanted into the right flank of male PSMA/CD3 humanized mice for the bispecific antibody efficacy studies.

Humanized PSMA/CD3 mice implanted with TRAMPC2_hPSMAv#1 were treated with 100 ug or 10 ug of anti-PSMA/anti-CD3 bispecific antibody BSPSMA/CD3-001 or BSPSMA/CD3-004 or an isotype control 2×/week starting from the day of tumor implantation. Serum cytokine levels 4 h post-injection were also examined, as well as spleen T-cell levels. Study was terminated at Day 27.

As the results in Table 10 show, both anti-PSMA/anti-CD3 bispecific molecules showed efficacy in significantly delaying tumor growth across treatment groups. Dose dependent cytokine release was observed after treatment with BSPSMA/CD3-001. Minimal cytokine release was observed after administration of BSPSMA/CD3-004, possibly due to the weak binding of the anti-CD3. BSPSMA/CD3-001 showed anti-tumor efficacy without depleting T cells in the spleen.

Efficacy of Anti-PSMA/Anti-CD3 Bispecific Antibodies on Established Tumors in Immune-competent Model Lastly, the efficacy of selected anti-PSMA/anti-CD3 bispecific molecules on reducing growth of established tumors in humanized PSMA/CD3 mice was assessed. TRAMP-C2_hPSMAv#1 cells were transplanted in humanized mice as described above, and 100 ug BSPSMA/CD3-001 or isotype control was administered i.p. 2×/week 14 days after tumor implantation, when tumor sizes ranged from 50 $mm^3$-100 $mm^3$. As the results in Table 11 show, BSPSMA/CD3-001 was efficacious in this established tumor model, displaying an 84% decrease in tumor growth compared to the control group.

In summary, the anti-PSMA/anti-CD3 bispecific antibodies of this invention display potent anti-tumor efficacy in both immune-compromised and immune-competent tumor models. Additionally, several of the tested bispecific antibodies (BSPSMA/CD3-001 and 002) displayed potent ability to reduce the volume of established tumors.

Of note, in the absence of PSMA-expressing tumor cells, no T cell activation was seen.

Additionally, in mice bearing no tumors, blood samples were collected 4 hours following PSMA×CD3 bispecific antibody treatment, and serum cytokine levels were determined. Transient increases in levels of cytokines, namely interferon-gamma (IFN-g), tumor necrosis factor (TNF), interleukin-2 (IL-2), and interleukin-6 (IL-6) were determined and the transient increases were dose-dependent (FIGS. 2A-2D).

Figures 3A, 3B:
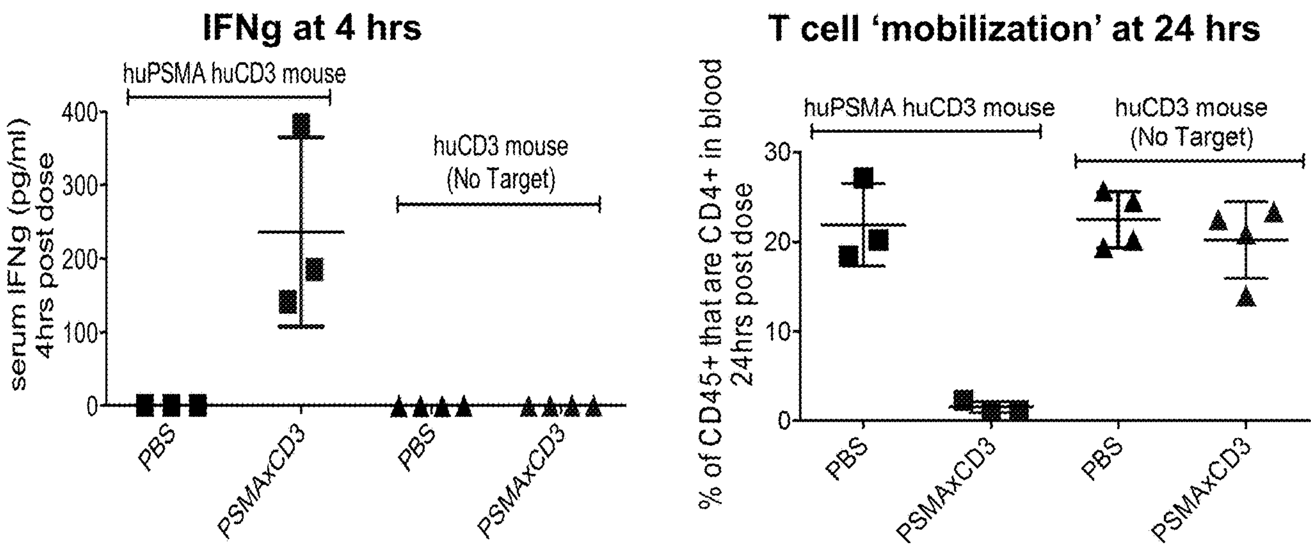
FIGS. 3A-3B illustrate that treatment with PSMA×CD3 bispecific antibody in a humanized T cell mouse (100 μg/mouse) induces acute increase in cytokines (e.g. IFNg) (FIG. 3A) as well as transient decrease in circulating T cells (FIG. 3B).

In order to validate the specificity of the bispecific antibodies, mice either humanized for both PSMA and CD3 or mice humanized for CD3 alone were dosed with 100 μg of PSMA×CD3 and examined for serum cytokines (4 hrs post dose) and transient T cell loss from the blood (24 hrs post dose). Treatment with PSMA×CD3 bispecific antibody in a humanized T cell mouse (100 μg/mouse) induces acute increase in cytokines (e.g. IFNg) as well as transient decrease in circulating T cells (FIGS. 3A-3B). This finding reproduces cytokine and T cell changes that have been observed in human patients treated with tumor antigen×CD3 bispecific antibodies.

Figures 4A, 4B:
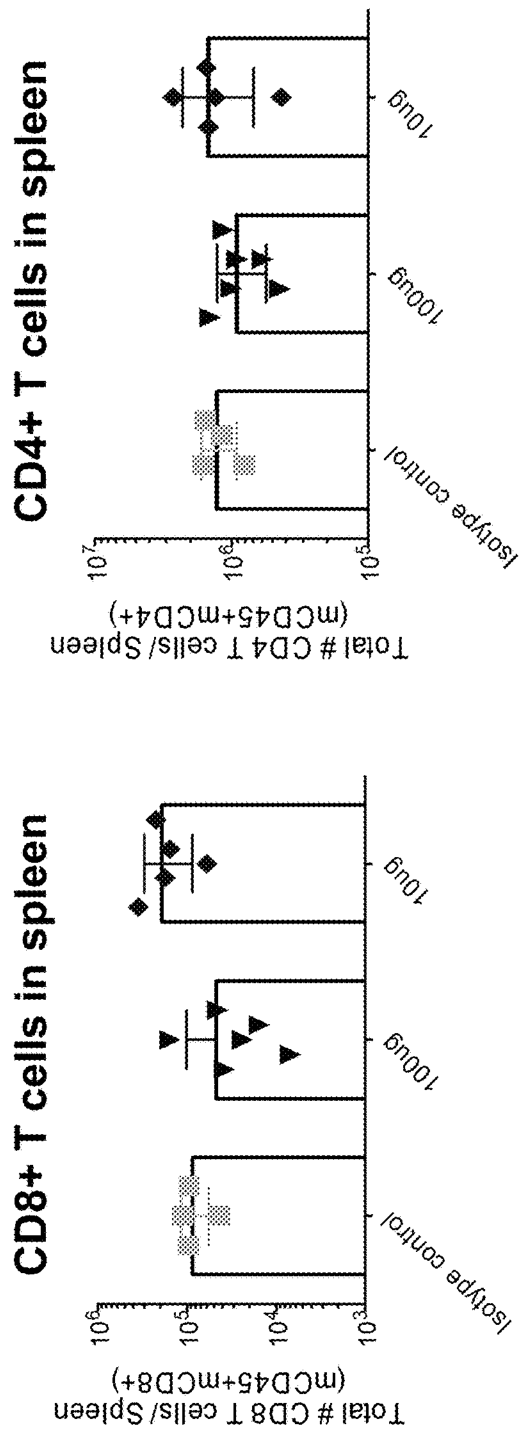
FIGS. 4A-4C illustrate the effect of PSMA×CD3 bispecific antibodies on effector T cells in the spleen of the immunocompetent mice.
Figure 4C:
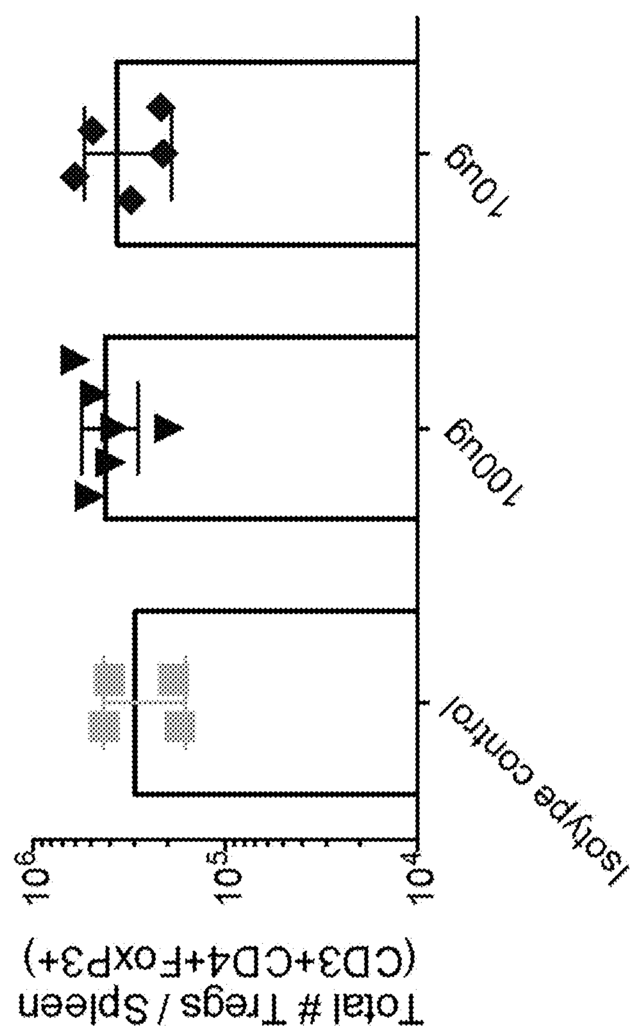

PSMA×CD3 bispecific antibodies are efficacious without depleting effector T cells in the spleen of the immunocompetent mice, as shown in FIGS. 4A-4C. Briefly, humanized PSMA and CD3 Velocigene® mice were implanted with hPSMA-expressing tumors and treated with PSMA×CD3 twice weekly. T cells were present at normal numbers at final harvest. Spleens were examined for CD4+ T cells, CD8+ T cells, and Tregs at the end of the experiment after treatment with PSMA×CD3 bispecific antibody twice per week throughout study. Mice humanized for PSMA and CD3 were implanted with TRAMP-C2_hPSMA tumors and dosed from day 0 with 100 μg or 10 μg of PSMA×CD3. Cell populations in the spleen were analyzed by flow cytometry. Data was analyzed using analysis of variance (ANOVA) for any significant effects compared to the isotype control group but no significant differences were found (FIGS. 4A-4C).

TABLE 9

Efficacy of anti-PSMA/anti-CD3 Bispecific Antibodies in Immune-Compromised Xenograft Models Xenogenic model: suppression of tumor growth

| Tumor Model/ Mouse Strain | N # mice/ treatment group | Bispecific Antibody Identifier | Dose | Final Tumor Volume ($mm^3$) Mean ± SD |
|---|---|---|---|---|
| 22Rv1/ | 5 | BSPSMA/CD3-001 | 1.0 ug/mouse | 370 ± 270 |
| NSG | 5 | Isotype Control | on day 0, 3 & 7 | 1260 ± 730 |
| C4-/2 | 5 | BSPSMA/CD3-001 | 0.1 mg/kg | 0 ± 0 |
| NSG | 5 | BSPSMA/CD3-003 | on day 0, 4 & 7 | 0 ± 0 |
| | 5 | BSPSMA/CD3-005 | | 0 ± 0 |
| | 5 | Isotype Control | | 960 ± 660 |
| C4-2/ SIRPα Balb/c-Rag2-IL2rγ-BRG engrafted with hCD34+ HSC | 5 | BSPSMA/CD3-004 | 1.0 ug/mouse 2x/week | 70 ± 60 |
| | 5 | Isotype Control | | 260 ± 180 |

Xenogenic model: inhibition of established tumor growth

| Tumor Model/ Mouse Strain | N # mice/ treatment group | Bispecific Antibody Identifier Dose: 20 ug/mouse | Tumor Growth ($mm^3$) from start of treatment (mean ± SD) | % Decrease Tumor Growth vs. Control |
|---|---|---|---|---|
| C4-2/ | 5 | BSPSMA/CD3-002 | 60 ± 100 | 95% |
| NSG | 4 | Isotype Control | 1170 ± 600 | (—) |

TABLE 10

Efficacy of anti-PSMA/anti-CD3 Bispecific antibodies in immune-competent syngeneic models

| Tumor Model/ Mouse Strain | Bispecific Antibody Identifier | Dose (ug/mouse) 2x/week* | N # mice/ treatment group | Tumor Volume ($mm^3$) at Day 27 (Mean ± SD) | Mean Serum Cytokine Concentrations, (pg/mL) | | | | | Spleen T-cell level %, (mean ± SD)[#] | |
|---|---|---|---|---|---|---|---|---|---|---|---|
| | | | | | IFNg | TNFa | IL-2 | IL-12p70 | IL-6 | CD4+ | CD8+ |
| TRAMP-C2/ $PSMA^{Hum/hum}$ $CD3^{Hum/Hum}$ | BSPSMA/CD3-001 | 100 | 4 | 260 ± 250 | 130 | 180 | 150 | 70 | 20 | 6.0 ± 1.0 | 13.0 ± 3.0 |
| | | 10 | 6 | 600 ± 330 | 80 | 140 | 140 | 30 | 1130 | 7.0 ± 2.0 | 14.0 ± 3.0 |
| | BSPSMA/CD3-004 | 100 | 4 | 50 ± 60 | 30 | 60 | 60 | 40 | 370 | 8.0 ± 1.0 | 12.0 ± 2.0 |
| | | 10 | 5 | 380 ± 650 | 10 | 50 | 50 | 10 | 330 | 8.0 ± 3.0 | 14.0 ± 4.0 |
| | Isotype Control | 100 | 5 | 1740 ± 560 | 4 | 30 | 30 | 10 | 230 | 5.0 ± 1.0 | 8.0 ± 2.0 |

*Mice were dosed with antibody or isotype control 2x/week starting on the day of tumor implantation

[#]Measured as the percentage of CD4+ or CD8+ cells in spleen out of live mCD45+ cells

TABLE 11

| Efficacy of anti-PSMA/anti-CD3 Bispecific antibodies in suppression of established tumor growth in immune competent syngeneic model Tumor efficacy in immune-competent model, established tumors | | | |
|---|---|---|---|
| Tumor Model/ Mouse Strain | Bispecific Antibody Identifier Dose: 100 ug/mouse | Tumor Growth ($mm^3$) from start of treatment (mean ± SD) | % Decrease Tumor Growth vs. Control |
| TRAMP-C2/ $PSMA^{Hum/hum}$ $CD3^{Hum/Hum}$ | BSPSMA/CD3-001 | 170 ± 170 | 84 |
| | Isotype Control | 740 ± 570 | (—) |

Example 9

Generation of Anti-CD3 Antibodies

Anti-CD3 antibodies were obtained by immunizing an engineered mouse comprising DNA encoding human Immunoglobulin heavy and kappa light chain variable regions with cells expressing CD3 or with DNA encoding CD3. The antibody immune response was monitored by a CD3-specific immunoassay. When a desired immune response was achieved, splenocytes were harvested and fused with mouse myeloma cells to preserve their viability and form hybridoma cell lines. The hybridoma cell lines were screened and selected to identify cell lines that produce CD3-specific antibodies. Using this technique several anti-CD3 chimeric antibodies (i.e., antibodies possessing human variable domains and mouse constant domains) were obtained. In addition, several fully human anti-CD3 antibodies were isolated directly from antigen-positive B cells without fusion to myeloma cells, as described in US 2007/0280945A1.

Certain biological properties of the exemplary anti-CD3 antibodies generated in accordance with the methods of this Example are described in detail in the Examples herein.

Example 10

Heavy and Light Chain Variable Region Amino Acid and Nucleic Acid Sequences

Table 12 sets forth the amino acid sequence identifiers of the heavy and light chain variable regions and CDRs of selected anti-CD3 antibodies of the invention. The corresponding nucleic acid sequence identifiers are set forth in Table 13. Methods of making the anti-CD3 antibodies disclosed herein can also be found in US publication 2014/0088295.

TABLE 12

| Amino Acid Sequence Identifiers | | | | | | | | |
|---|---|---|---|---|---|---|---|---|
| Antibody | SEQ ID NOs: | | | | | | | |
| Designation | HCVR | HCDR1 | | HCDR3 | LCVR | LCDR11 | LCDR2 | LCDR3 |
| H1H2712N | 154 | 156 | 158 | 160 | 162 | 164 | 166 | 168 |
| H1M2692N | 170 | 172 | 174 | 176 | 178 | 180 | 182 | 184 |
| H1M3542N | 186 | 188 | 190 | 192 | 194 | 196 | 198 | 200 |
| H1M3544N | 202 | 204 | 206 | 208 | 210 | 212 | 214 | 216 |
| H1M3549N | 218 | 220 | 222 | 224 | 226 | 228 | 230 | 232 |
| H1M3613N | 234 | 236 | 238 | 240 | 242 | 244 | 246 | 248 |
| H2M2689N | 250 | 252 | 254 | 256 | 258 | 260 | 262 | 264 |
| H2M2690N | 266 | 268 | 270 | 272 | 274 | 276 | 278 | 280 |
| H2M2691N | 282 | 284 | 286 | 288 | 290 | 292 | 294 | 296 |
| H2M2704N | 298 | 300 | 302 | 304 | 306 | 308 | 310 | 312 |
| H2M2705N | 314 | 316 | 318 | 320 | 322 | 324 | 326 | 328 |
| H2M2706N | 330 | 332 | 334 | 336 | 338 | 340 | 342 | 344 |
| H2M2707N | 346 | 348 | 350 | 352 | 354 | 356 | 358 | 360 |
| H2M2708N | 362 | 364 | 366 | 368 | 370 | 372 | 374 | 376 |
| H2M2709N | 378 | 380 | 382 | 384 | 386 | 388 | 390 | 392 |
| H2M2710N | 394 | 396 | 398 | 400 | 402 | 404 | 406 | 408 |
| H2M2711N | 410 | 412 | 414 | 416 | 418 | 420 | 422 | 424 |
| H2M2774N | 426 | 428 | 430 | 432 | 434 | 436 | 438 | 440 |
| H2M2775N | 442 | 444 | 446 | 448 | 450 | 452 | 454 | 456 |
| H2M2776N | 458 | 460 | 462 | 464 | 466 | 468 | 470 | 472 |
| H2M2777N | 474 | 476 | 478 | 480 | 482 | 484 | 486 | 488 |
| H2M2778N | 490 | 492 | 494 | 496 | 498 | 500 | 502 | 504 |
| H2M2779N | 506 | 508 | 510 | 512 | 514 | 516 | 518 | 520 |
| H2M2789N | 522 | 524 | 526 | 528 | 530 | 532 | 534 | 536 |
| H2M2862N | 538 | 540 | 542 | 544 | 546 | 548 | 550 | 552 |
| H2M2885N | 554 | 556 | 558 | 560 | 562 | 564 | 566 | 568 |
| H2M2886N | 570 | 572 | 574 | 576 | 578 | 580 | 582 | 584 |
| H2M3540N | 586 | 588 | 590 | 592 | 594 | 596 | 598 | 600 |
| H2M3541N | 602 | 604 | 606 | 608 | 610 | 612 | 614 | 616 |
| H2M3543N | 618 | 620 | 622 | 624 | 626 | 628 | 630 | 632 |
| H2M3547N | 634 | 636 | 638 | 640 | 642 | 644 | 646 | 648 |
| H2M3548N | 650 | 652 | 654 | 656 | 658 | 660 | 662 | 664 |
| H2M3563N | 666 | 668 | 670 | 672 | 674 | 676 | 678 | 680 |
| H1H5751P | 682 | 684 | 686 | 688 | 690 | 692 | 694 | 696 |
| H1H5752P | 698 | 700 | 702 | 704 | 706 | 708 | 710 | 712 |
| H1H5753B | 714 | 716 | 718 | 720 | 722 | 724 | 726 | 728 |
| H1H5754B | 730 | 732 | 734 | 736 | 738 | 740 | 742 | 744 |
| H1H5755B | 746 | 748 | 750 | 752 | 754 | 756 | 758 | 760 |
| H1H5756B | 762 | 764 | 766 | 768 | 770 | 772 | 774 | 776 |
| H1H5757B | 778 | 780 | 782 | 784 | 786 | 788 | 790 | 792 |
| H1H5758B | 794 | 796 | 798 | 800 | 802 | 804 | 806 | 808 |

TABLE 12-continued

| Amino Acid Sequence Identifiers | | | | | | | | |
|---|---|---|---|---|---|---|---|---|
| Antibody | SEQ ID NOs: | | | | | | | |
| Designation | HCVR | HCDR1 | | HCDR3 | LCVR | LCDR11 | LCDR2 | LCDR3 |
| H1H5761P | 810 | 812 | 814 | 816 | 818 | 820 | 822 | 824 |
| H1H5763P | 826 | 828 | 830 | 832 | 834 | 836 | 838 | 840 |
| H1H5764P | 842 | 844 | 846 | 848 | 850 | 852 | 854 | 856 |
| H1H5769P | 858 | 860 | 862 | 864 | 866 | 868 | 870 | 872 |
| H1H5771P | 874 | 876 | 878 | 880 | 882 | 884 | 886 | 888 |
| H1H5772P | 890 | 892 | 894 | 896 | 898 | 900 | 902 | 904 |
| H1H5777P | 906 | 908 | 910 | 912 | 914 | 916 | 918 | 920 |
| H1H5778P | 922 | 924 | 926 | 928 | 930 | 932 | 934 | 936 |
| H1H5780P | 938 | 940 | 942 | 944 | 946 | 948 | 950 | 952 |
| H1H5781P | 954 | 956 | 958 | 960 | 962 | 964 | 966 | 968 |
| H1H5782P | 970 | 972 | 974 | 976 | 978 | 980 | 982 | 984 |
| H1H5785B | 986 | 988 | 990 | 992 | 994 | 996 | 998 | 1000 |
| H1H5786B | 1002 | 1004 | 1006 | 1008 | 1010 | 1012 | 1014 | 1016 |
| H1H5788P | 1018 | 1020 | 1022 | 1024 | 1026 | 1028 | 1030 | 1032 |
| H1H5790B | 1034 | 1036 | 1038 | 1040 | 1042 | 1044 | 1046 | 1048 |
| H1H5791B | 1050 | 1052 | 1054 | 1056 | 1058 | 1060 | 1062 | 1064 |
| H1H5792B | 1066 | 1068 | 1070 | 1072 | 1074 | 1076 | 1078 | 1080 |
| H1H5793B | 1082 | 1084 | 1086 | 1088 | 1090 | 1092 | 1094 | 1096 |
| H1H5795B | 1098 | 1100 | 1102 | 1104 | 1106 | 1108 | 1110 | 1112 |
| H1H5796B | 1114 | 1116 | 1118 | 1120 | 1122 | 1124 | 1126 | 1128 |
| H1H5797B | 1130 | 1132 | 1134 | 1136 | 1138 | 1140 | 1142 | 1144 |
| H1H5798B | 1146 | 1148 | 1150 | 1152 | 1154 | 1156 | 1158 | 1160 |
| H1H5799P | 1162 | 1164 | 1166 | 1168 | 1170 | 1172 | 1174 | 1176 |
| H1H5801B | 1178 | 1180 | 1182 | 1184 | 1186 | 1188 | 1190 | 1192 |
| H1H7194B | 1194 | 1196 | 1198 | 1200 | 1386 | 1388 | 1390 | 1392 |
| H1H7195B | 1202 | 1204 | 1206 | 1208 | 1386 | 1388 | 1390 | 1392 |
| H1H7196B | 1210 | 1212 | 1214 | 1216 | 1386 | 1388 | 1390 | 1392 |
| H1H7198B | 1218 | 1220 | 1222 | 1224 | 1386 | 1388 | 1390 | 1392 |
| H1H7203B | 1226 | 1228 | 1230 | 1232 | 1386 | 1388 | 1390 | 1392 |
| H1H7204B | 1234 | 1236 | 1238 | 1240 | 1386 | 1388 | 1390 | 1392 |
| H1H7208B | 1242 | 1244 | 1246 | 1248 | 1386 | 1388 | 1390 | 1392 |
| H1H7211B | 1250 | 1252 | 1254 | 1256 | 1386 | 1388 | 1390 | 1392 |
| H1H7221B | 1258 | 1260 | 1262 | 1264 | 1386 | 1388 | 1390 | 1392 |
| H1H7223B | 1266 | 1268 | 1270 | 1272 | 1386 | 1388 | 1390 | 1392 |
| H1H7226B | 1274 | 1276 | 1278 | 1280 | 1386 | 1388 | 1390 | 1392 |
| H1H7232B | 1282 | 1284 | 1286 | 1288 | 1386 | 1388 | 1390 | 1392 |
| H1H7233B | 1290 | 1292 | 1294 | 1296 | 1386 | 1388 | 1390 | 1392 |
| H1H7241B | 1298 | 1300 | 1302 | 1304 | 1386 | 1388 | 1390 | 1392 |
| H1H7242B | 1306 | 1308 | 1310 | 1312 | 1386 | 1388 | 1390 | 1392 |
| H1H7250B | 1314 | 1316 | 1318 | 1320 | 1386 | 1388 | 1390 | 1392 |
| H1H7251B | 1322 | 1324 | 1326 | 1328 | 1386 | 1388 | 1390 | 1392 |
| H1H7254B | 1330 | 1332 | 1334 | 1336 | 1386 | 1388 | 1390 | 1392 |
| H1H7258B | 1338 | 1340 | 1342 | 1344 | 1386 | 1388 | 1390 | 1392 |
| H1H7269B | 1346 | 1348 | 1350 | 1352 | 1386 | 1388 | 1390 | 1392 |
| H1H7279B | 1354 | 1356 | 1358 | 1360 | 1386 | 1388 | 1390 | 1392 |
| H1xH7221G | 1362 | 1364 | 1366 | 1368 | 1386 | 1388 | 1390 | 1392 |
| H1xH7221G3 | 1370 | 1372 | 1374 | 1376 | 1386 | 1388 | 1390 | 1392 |
| H1xH7221G5 | 1378 | 1380 | 1382 | 1384 | 1386 | 1388 | 1390 | 1392 |

TABLE 13

| Nucleic Acid Sequence Identifiers | | | | | | | | |
|---|---|---|---|---|---|---|---|---|
| Antibody | SEQ ID NOs: | | | | | | | |
| Designation | HCVR | HCDR1 | HCDR2 | HCDR3 | LCVR | LCDR1 | LCDR2 | LCDR3 |
| H1H2712N | 153 | 155 | 157 | 159 | 161 | 163 | 165 | 167 |
| H1M2692N | 169 | 171 | 173 | 175 | 177 | 179 | 181 | 183 |
| H1M3542N | 185 | 187 | 189 | 191 | 193 | 195 | 197 | 199 |
| H1M3544N | 201 | 203 | 205 | 207 | 209 | 211 | 213 | 215 |
| H1M3549N | 217 | 219 | 221 | 223 | 225 | 227 | 229 | 231 |
| H1M3613N | 233 | 235 | 237 | 239 | 241 | 243 | 245 | 247 |
| H2M2689N | 249 | 251 | 253 | 255 | 257 | 259 | 261 | 263 |
| H2M2690N | 265 | 267 | 269 | 271 | 273 | 275 | 277 | 279 |
| H2M2691N | 281 | 283 | 285 | 287 | 289 | 291 | 293 | 295 |
| H2M2704N | 297 | 299 | 301 | 303 | 305 | 307 | 309 | 311 |
| H2M2705N | 313 | 315 | 317 | 319 | 321 | 323 | 325 | 327 |
| H2M2706N | 329 | 331 | 333 | 335 | 337 | 339 | 341 | 343 |
| H2M2707N | 345 | 347 | 349 | 351 | 353 | 355 | 357 | 359 |
| H2M2708N | 361 | 363 | 365 | 367 | 369 | 371 | 373 | 375 |

TABLE 13-continued

| Nucleic Acid Sequence Identifiers | | | | | | | | |
|---|---|---|---|---|---|---|---|---|
| Antibody | SEQ ID NOs: | | | | | | | |
| Designation | HCVR | HCDR1 | HCDR2 | HCDR3 | LCVR | LCDR1 | LCDR2 | LCDR3 |
| H2M2709N | 377 | 379 | 381 | 383 | 385 | 387 | 389 | 391 |
| H2M2710N | 393 | 395 | 397 | 399 | 401 | 403 | 405 | 407 |
| H2M2711N | 409 | 411 | 413 | 415 | 417 | 419 | 421 | 423 |
| H2M2774N | 425 | 427 | 429 | 431 | 433 | 435 | 437 | 439 |
| H2M2775N | 441 | 443 | 445 | 447 | 449 | 451 | 453 | 455 |
| H2M2776N | 457 | 459 | 461 | 463 | 465 | 467 | 469 | 471 |
| H2M2777N | 473 | 475 | 477 | 479 | 481 | 483 | 485 | 487 |
| H2M2778N | 489 | 491 | 493 | 495 | 497 | 499 | 501 | 503 |
| H2M2779N | 505 | 507 | 509 | 511 | 513 | 515 | 517 | 519 |
| H2M2789N | 521 | 523 | 525 | 527 | 529 | 531 | 533 | 535 |
| H2M2862N | 537 | 539 | 541 | 543 | 545 | 547 | 549 | 551 |
| H2M2885N | 553 | 555 | 557 | 559 | 561 | 563 | 565 | 567 |
| H2M2886N | 569 | 571 | 573 | 575 | 577 | 579 | 581 | 583 |
| H2M3540N | 585 | 587 | 589 | 591 | 593 | 595 | 597 | 599 |
| H2M3541N | 601 | 603 | 605 | 607 | 609 | 611 | 613 | 615 |
| H2M3543N | 617 | 619 | 621 | 623 | 625 | 627 | 629 | 631 |
| H2M3547N | 633 | 635 | 637 | 639 | 641 | 643 | 645 | 647 |
| H2M3548N | 649 | 651 | 653 | 655 | 657 | 659 | 661 | 663 |
| H2M3563N | 665 | 667 | 669 | 671 | 673 | 675 | 677 | 679 |
| H1H5751P | 681 | 683 | 685 | 687 | 689 | 691 | 693 | 695 |
| H1H5752P | 697 | 699 | 701 | 703 | 705 | 707 | 709 | 711 |
| H1H5753B | 713 | 715 | 717 | 719 | 721 | 723 | 725 | 727 |
| H1H5754B | 729 | 731 | 733 | 735 | 737 | 739 | 741 | 743 |
| H1H5755B | 745 | 747 | 749 | 751 | 753 | 755 | 757 | 759 |
| H1H5756B | 761 | 763 | 765 | 767 | 769 | 771 | 773 | 775 |
| H1H5757B | 777 | 779 | 781 | 783 | 785 | 787 | 789 | 791 |
| H1H5758B | 793 | 795 | 797 | 799 | 801 | 803 | 805 | 807 |
| H1H5761P | 809 | 811 | 813 | 815 | 817 | 819 | 821 | 823 |
| H1H5763P | 825 | 827 | 829 | 831 | 833 | 835 | 837 | 839 |
| H1H5764P | 841 | 843 | 845 | 847 | 849 | 851 | 853 | 855 |
| H1H5769P | 857 | 859 | 861 | 863 | 865 | 867 | 869 | 871 |
| H1H5771P | 873 | 875 | 877 | 879 | 881 | 883 | 885 | 887 |
| H1H5772P | 889 | 891 | 893 | 895 | 897 | 899 | 901 | 903 |
| H1H5777P | 905 | 907 | 909 | 911 | 913 | 915 | 917 | 919 |
| H1H5778P | 921 | 923 | 925 | 927 | 929 | 931 | 933 | 935 |
| H1H5780P | 937 | 939 | 941 | 943 | 945 | 947 | 949 | 951 |
| H1H5781P | 953 | 955 | 957 | 959 | 961 | 963 | 965 | 967 |
| H1H5782P | 969 | 971 | 973 | 975 | 977 | 979 | 981 | 983 |
| H1H5785B | 985 | 987 | 989 | 991 | 993 | 995 | 997 | 999 |
| H1H5786B | 1001 | 1003 | 1005 | 1007 | 1009 | 1011 | 1013 | 1015 |
| H1H5788P | 1017 | 1019 | 1021 | 1023 | 1025 | 1027 | 1029 | 1031 |
| H1H5790B | 1033 | 1035 | 1037 | 1039 | 1041 | 1043 | 1045 | 1047 |
| H1H5791B | 1049 | 1051 | 1053 | 1055 | 1057 | 1059 | 1061 | 1063 |
| H1H5792B | 1065 | 1067 | 1069 | 1071 | 1073 | 1075 | 1077 | 1079 |
| H1H5793B | 1081 | 1083 | 1085 | 1087 | 1089 | 1091 | 1093 | 1095 |
| H1H5795B | 1097 | 1099 | 1101 | 1103 | 1105 | 1107 | 1109 | 1111 |
| H1H5796B | 1113 | 1115 | 1117 | 1119 | 1121 | 1123 | 1125 | 1127 |
| H1H5797B | 1129 | 1131 | 1133 | 1135 | 1137 | 1139 | 1141 | 1143 |
| H1H5798B | 1145 | 1147 | 1149 | 1151 | 1153 | 1155 | 1157 | 1159 |
| H1H5799P | 1161 | 1163 | 1165 | 1167 | 1169 | 1171 | 1173 | 1175 |
| H1H5801B | 1177 | 1179 | 1181 | 1183 | 1185 | 1187 | 1189 | 1191 |
| H1H7194B | 1193 | 1195 | 1197 | 1199 | 1385 | 1387 | 1389 | 1391 |
| H1H7195B | 1201 | 1203 | 1205 | 1207 | 1385 | 1387 | 1389 | 1391 |
| H1H7196B | 1209 | 1211 | 1213 | 1215 | 1385 | 1387 | 1389 | 1391 |
| H1H7198B | 1217 | 1219 | 1221 | 1223 | 1385 | 1387 | 1389 | 1391 |
| H1H7203B | 1225 | 1227 | 1229 | 1231 | 1385 | 1387 | 1389 | 1391 |
| H1H7204B | 1233 | 1235 | 1237 | 1239 | 1385 | 1387 | 1389 | 1391 |
| H1H7208B | 1241 | 1243 | 1245 | 1247 | 1385 | 1387 | 1389 | 1391 |
| H1H7211B | 1249 | 1251 | 1253 | 1255 | 1385 | 1387 | 1389 | 1391 |
| H1H7221B | 1257 | 1259 | 1261 | 1263 | 1385 | 1387 | 1389 | 1391 |
| H1H7223B | 1265 | 1267 | 1269 | 1271 | 1385 | 1387 | 1389 | 1391 |
| H1H7226B | 1273 | 1275 | 1277 | 1279 | 1385 | 1387 | 1389 | 1391 |
| H1H7232B | 1281 | 1283 | 1285 | 1287 | 1385 | 1387 | 1389 | 1391 |
| H1H7233B | 1289 | 1291 | 1293 | 1295 | 1385 | 1387 | 1389 | 1391 |
| H1H7241B | 1297 | 1299 | 1301 | 1303 | 1385 | 1387 | 1389 | 1391 |
| H1H7242B | 1305 | 1307 | 1309 | 1311 | 1385 | 1387 | 1389 | 1391 |
| H1H7250B | 1313 | 1315 | 1317 | 1319 | 1385 | 1387 | 1389 | 1391 |
| H1H7251B | 1321 | 1323 | 1325 | 1327 | 1385 | 1387 | 1389 | 1391 |
| H1H7254B | 1329 | 1331 | 1333 | 1335 | 1385 | 1387 | 1389 | 1391 |
| H1H7258B | 1337 | 1339 | 1341 | 1343 | 1385 | 1387 | 1389 | 1391 |
| H1H7269B | 1345 | 1347 | 1349 | 1351 | 1385 | 1387 | 1389 | 1391 |
| H1H7279B | 1353 | 1355 | 1357 | 1359 | 1385 | 1387 | 1389 | 1391 |
| H1xH7221G | 1361 | 1363 | 1365 | 1367 | 1385 | 1387 | 1389 | 1391 |

TABLE 13-continued

| Nucleic Acid Sequence Identifiers | | | | | | | | |
|---|---|---|---|---|---|---|---|---|
| Antibody | SEQ ID NOs: | | | | | | | |
| Designation | HCVR | HCDR1 | HCDR2 | HCDR3 | LCVR | LCDR1 | LCDR2 | LCDR3 |
| H1xH7221G3 | 1369 | 1371 | 1373 | 1375 | 1385 | 1387 | 1389 | 1391 |
| H1xH7221G5 | 1377 | 1379 | 1381 | 1383 | 1385 | 1387 | 1389 | 1391 |

Antibodies are typically referred to herein according to the following nomenclature: Fc prefix (e.g. "H1H," "H1M," "H2M," etc.), followed by a numerical identifier (e.g. "2712," "2692," etc., as shown in Table 1), followed by a "P," "N," or "B" suffix. Thus, according to this nomenclature, an antibody may be referred to herein as, e.g., "H1H2712N," "H1M2692N," "H2M2689N," etc. The H1H, H1M and H2M prefixes on the antibody designations used herein indicate the particular Fc region isotype of the antibody. For example, an "H1H" antibody has a human IgG1 Fc, an "H1M" antibody has a mouse IgG1 Fc, and an "H2M" antibody has a mouse IgG2 Fc, (all variable regions are fully human as denoted by the first 'H' in the antibody designation). As will be appreciated by a person of ordinary skill in the art, an antibody having a particular Fc isotype can be converted to an antibody with a different Fc isotype (e.g., an antibody with a mouse IgG1 Fc can be converted to an antibody with a human IgG4, etc.), but in any event, the variable domains (including the CDRs)—which are indicated by the numerical identifiers shown in Table 1—will remain the same, and the binding properties are expected to be identical or substantially similar regardless of the nature of the Fc domain.

Tables 14 and 15 set out the amino acid sequence identifiers for heavy chain variable regions (Table 14) and light chain variable regions (Table 15), and their corresponding CDRs, of additional anti-CD3 HCVRs and LCVRs useful in anti-PSMA×anti-CD3 bispecific antibodies of the invention.

TABLE 14

| (Heavy Chain Variable Region Amino Acid Sequences) | | | | |
|---|---|---|---|---|
| Heavy Chain | SEQ ID NOs | | | |
| Identifier | HCVR | HCDR1 | HCDR2 | HCDR3 |
| CD3-VH-AA | 1394 | 1396 | 1398 | 1400 |
| CD3-VH-B | 1410 | 1412 | 1414 | 1416 |
| CD3-VH-C | 1426 | 1428 | 1430 | 1432 |
| CD3-VH-D | 1442 | 1444 | 1446 | 1448 |
| CD3-VH-E | 1458 | 1460 | 1462 | 1464 |
| CD3-VH-F[#] | 1473 | 1474 | 1475 | 1476 |

TABLE 15

| (Light Chain Variable Region Amino Acid Sequences) | | | | |
|---|---|---|---|---|
| Light Chain | SEQ ID NOs | | | |
| Identifier | LCVR | LCDR1 | LCDR2 | LCDR3 |
| CD3-VL-AA | 1402 | 1404 | 1406 | 1408 |
| CD3-VL-B | 1418 | 1420 | 1422 | 1424 |
| CD3-VL-C | 1434 | 1436 | 1438 | 1440 |
| CD3-VL-D | 1450 | 1452 | 1454 | 1456 |
| CD3-VL-E | 1466 | 1468 | 1470 | 1472 |
| CD3-VL-F[#] | 1477 | 1478 | 1479 | 1480 |

The heavy and light chain variable regions of CD3-VH-F and CD3-VL-F were derived from the anti-CD3 antibody designated "L2K" as set forth in WO2004/106380.

In addition, Tables 16 and 17 set out the sequence identifiers for the nucleotide sequences encoding the heavy chain variable regions (Table 16) and light chain variable regions (Table 17), and their corresponding CDRs, of additional anti-CD3 HCVRs and LCVRs useful in anti-PSMA×anti-CD3 bispecific antibodies of the invention.

TABLE 16

| (Nucleotide Sequences Encoding Heavy Chain Variable Region Sequences) | | | | |
|---|---|---|---|---|
| Heavy Chain | SEQ ID NOs | | | |
| Identifier | HCVR | HCDR1 | HCDR2 | HCDR3 |
| CD3-VH-AA | 1393 | 1395 | 1397 | 1399 |
| CD3-VH-B | 1409 | 1411 | 1413 | 1415 |
| CD3-VH-C | 1425 | 1427 | 1429 | 1431 |
| CD3-VH-D | 1441 | 1443 | 1445 | 1447 |
| CD3-VH-E | 1457 | 1459 | 1461 | 1463 |

TABLE 17

| (Nucleotide Sequences Encoding Light Chain Variable Region Sequences) | | | | |
|---|---|---|---|---|
| Light Chain | SEQ ID NOs | | | |
| Identifier | LCVR | LCDR1 | LCDR2 | LCDR3 |
| CD3-VL-AA | 1401 | 1403 | 1405 | 1407 |
| CD3-VL-B | 1417 | 1419 | 1421 | 1423 |
| CD3-VL-C | 1433 | 1435 | 1437 | 1439 |
| CD3-VL-D | 1449 | 1451 | 1453 | 1455 |
| CD3-VL-E | 1465 | 1467 | 1469 | 1471 |

Control Constructs Used in the Following Examples

Various control constructs (anti-CD3 antibodies) were included in the following experiments for comparative purposes: "OKT-3," a mouse monoclonal antibody against human T-cell surface antigens available from the American Type Culture Collection (ATCC) under catalog no. CRL-8001; and "SP34," a commercially available mouse monoclonal antibody obtained, e.g., from Biolegend, San Diego, Calif. (Cat. No. 302914) or BD Pharmagen, Cat. 55052, reactive against the epsilon chain of the T3 complex on human T lymphocyte cells.

Example 11

Generation of Additional Anti-CD3 Antibodies

The following procedures were aimed at identifying antibodies that specifically recognized CD3 (T cell co-receptor) as an antigen.

A pool of anti-CD3 antibodies were derived from a genetically modified mouse. Briefly, mice were immunized with a CD3 antigen and generated B cells that comprised a diversity of human VH rearrangements in order to express a diverse repertoire of high-affinity antigen-specific antibodies. Antibodies described in Tables 18-21 have the same light chain sequence of VK1-39JK5 (LCVR set forth in SEQ ID NO: 1642).

Generated antibodies were tested for affinity to human and cynomolgus monkey CD3 antigen in an in vitro binding assay, and e.g. one CD3 antibody: designated CD3-VH-P (HCVR set forth in SEQ ID NO: 1634) was identified, amongst a few others, that were found to bind to both human and cynomolgus CD3 having an $EC_{50}$ between 1 and 40 nM affinity, as determined in a FACS titration of Jurkat cells and cynomolgus T cells, respectively. See, e.g. FACS binding experiments outlined in Example 5.

The germline amino acid residues of CD3-VH-P were subsequently identified and an antibody designated "CD3-VH-G" was engineered to contain only germline frameworks. Other antibody derivatives were engineered by well-known molecular cloning techniques to replace amino acid residues in a stepwise manner based on differences between the germline sequence and the CD3-VH-P sequence. Each antibody derivative is given a "CD3-VH-G" number designation. See Table 18.

While CD3-VH-G and some other engineered antibodies retained their binding affinity as seen in the FACS assays, several anti-CD3 antibodies bound to human or cyno CD3 in vitro with weak to no measurable binding affinity, such as 40 nM EC50. Binding affinities, binding kinetics, and other biological properties to elucidate toxicity and pharmacokinetic (pK) profiles were subsequently investigated for bispecific antibodies comprising the exemplary anti-CD3 antibodies generated in accordance with the methods of this Example, are described in detail in the Examples herein.

Example 12

Heavy and Light Chain Variable Regions (Amino Acid and Nucleic Acid Sequences of the CDRs)

Table 18 sets forth the amino acid sequence identifiers of the heavy chain variable regions and CDRs of selected anti-CD3 antibodies of the invention. The corresponding nucleic acid sequence identifiers are set forth in Table 19.

Amino acid and nucleic acid sequences were determined for each antibody heavy chain sequence. Each antibody heavy chain derived from the germline sequence (SEQ ID NO: 1662) was assigned a "G" number designation for consistent nomenclature. Table 2 sets forth the amino acid sequence identifiers of the heavy chain variable regions and CDRs of engineered anti-CD3 antibodies of the invention. The corresponding nucleic acid sequence identifiers are set forth in Table 19. The amino acid and nucleic acid sequence identifiers of the light chain variable region and CDRs are also identified below in Tables 20 and 21, respectively.

TABLE 18

Heavy Chain Amino Acid Sequence Identifiers

| Antibody CD3-VH Designation | SEQ ID NOs: HCVR | CDR1 | CDR2 | CDR3 |
|---|---|---|---|---|
| CD3-VH-G | 1482 | 1484 | 1486 | 1488 |
| CD3-VH-G2 | 1490 | 1492 | 1494 | 1496 |
| CD3-VH-G3 | 1498 | 1500 | 1502 | 1504 |
| CD3-VH-G4 | 1506 | 1508 | 1510 | 1512 |
| CD3-VH-G5 | 1514 | 1516 | 1518 | 1520 |
| CD3-VH-G8 | 1522 | 1524 | 1526 | 1528 |
| CD3-VH-G9 | 1530 | 1532 | 1534 | 1536 |
| CD3-VH-G10 | 1538 | 1540 | 1542 | 1544 |
| CD3-VH-G11 | 1546 | 1548 | 1550 | 1552 |
| CD3-VH-G12 | 1554 | 1556 | 1558 | 1560 |
| CD3-VH-G13 | 1562 | 1564 | 1566 | 1568 |
| CD3-VH-G14 | 1570 | 1572 | 1574 | 1576 |
| CD3-VH-G15 | 1578 | 1580 | 1582 | 1584 |
| CD3-VH-G16 | 1586 | 1588 | 1590 | 1592 |
| CD3-VH-G17 | 1594 | 1596 | 1598 | 1600 |
| CD3-VH-G18 | 1602 | 1604 | 1606 | 1608 |
| CD3-VH-G19 | 1610 | 1612 | 1614 | 1616 |
| CD3-VH-G20 | 1618 | 1620 | 1622 | 1624 |
| CD3-VH-G21 | 1626 | 1628 | 1630 | 1632 |
| CD3-VH-P | 1634 | 1636 | 1638 | 1640 |

TABLE 19

Heavy Chain Nucleic Acid Sequence Identifiers

| Antibody CD3-VH Designation | SEQ ID NOs: HCVR | CDR1 | CDR2 | CDR3 |
|---|---|---|---|---|
| CD3-VH-G | 1481 | 1483 | 1485 | 1487 |
| CD3-VH-G2 | 1489 | 1491 | 1493 | 1495 |
| CD3-VH-G3 | 1497 | 1499 | 1501 | 1503 |
| CD3-VH-G4 | 1505 | 1507 | 1509 | 1511 |
| CD3-VH-G5 | 1513 | 1515 | 1517 | 1519 |
| CD3-VH-G8 | 1521 | 1523 | 1525 | 1527 |
| CD3-VH-G9 | 1529 | 1531 | 1533 | 1535 |
| CD3-VH-G10 | 1537 | 1539 | 1541 | 1543 |
| CD3-VH-G11 | 1545 | 1547 | 1549 | 1551 |
| CD3-VH-G12 | 1553 | 1555 | 1557 | 1559 |
| CD3-VH-G13 | 1561 | 1563 | 1565 | 1567 |
| CD3-VH-G14 | 1569 | 1571 | 1573 | 1575 |
| CD3-VH-G15 | 1577 | 1579 | 1581 | 1583 |
| CD3-VH-G16 | 1585 | 1587 | 1589 | 1591 |
| CD3-VH-G17 | 1593 | 1595 | 1597 | 1599 |
| CD3-VH-G18 | 1601 | 1603 | 1605 | 1607 |
| CD3-VH-G19 | 1609 | 1611 | 1613 | 1615 |
| CD3-VH-G20 | 1617 | 1619 | 1621 | 1623 |
| CD3-VH-G21 | 1625 | 1627 | 1629 | 1631 |
| CD3-VH-P | 1633 | 1635 | 1637 | 1639 |

TABLE 20

Light Chain Amino Acid Sequence Identifiers

| Antibody Designation | SEQ ID NOs: LCVR | CDR1 | CDR2 | CDR3 |
|---|---|---|---|---|
| VK1-39JK5 | 1642 | 1644 | 1646 | 1648 |

TABLE 21

Light Chain Nucleic Acid Sequence Identifiers

| Antibody Designation | SEQ ID NOs: LCVR | CDR1 | CDR2 | CDR3 |
|---|---|---|---|---|
| VK1-39JK5 | 1641 | 1643 | 1645 | 1647 |

Control 1 antibody designated "CD3-L2K" was constructed based on a known anti-CD3 antibody (i.e., the anti-CD3 antibody "L2K" as set forth in WO2004/106380).

Isotype Control Antibody, referred to in the Examples herein, is an isotype matched (modified IgG4) antibody that interacts with an irrelevant antigen, i.e. FelD1 antigen.

Example 13

Surface Plasmon Resonance Derived Binding Affinities and Kinetic Constants of Human Monoclonal Anti-CD3 Antibodies Binding affinities and kinetic constants of human monoclonal anti-CD3 antibodies were determined by surface plasmon resonance at 25° C. using either an antibody-capture format (Tables 22, 24, and 26) or an antigen-capture format (Tables 23, 25, and 27). Measurements were conducted on a T200 Biacore™ instrument.

In the antibody-capture format, the Biacore™ sensor surface was derivatized with a rabbit anti-mouse Fc for hybridoma capture (antibody prefix H1M or H2M) or a mouse anti-human Fc surface for human IgG formatted antibodies (antibody prefix H1H). Soluble heterodimeric CD3 protein (hCD3-epsilon/hCD3-delta; SEQ ID NOs: 1652/1653) with either a human Fc tag (hFcΔAdp/hFc; SEQ ID NOs:1683/1684) ora mouse Fc tag (mFcΔAdp/mFc; SEQ ID NOs:1685/1686) was injected over the antibody captured surface and the binding response was recorded. Heterodimeric CD3 protein was purified using the method described in Davis et al. (US2010/0331527).

In the antigen-capture format, heterodimeric CD3 protein was captured using a rabbit anti-mouse Fc or mouse anti-human Fc and the respective antibodies were injected over the captured antigen.

Antibodies were analyzed in their conventional divalent format (Tables 22-25) or in a monovalent 1-arm configuration (Tables 26-27) in which the second Fab from the antibody was removed and only the Fc portion (CH2-CH3) was expressed.

Kinetic association ($k_a$) and dissociation ($k_d$) rate constants were determined by processing and fitting the data to a 1:1 binding model using Scrubber 2.0 curve fitting software. Binding dissociation equilibrium constants ($K_D$) and dissociative half-lives ($t_{1/2}$) were calculated from the kinetic rate constants as: $K_D$ (M)=$k_d/k_a$; and $t_{1/2}$ (min)=(In2/(60*$k_d$). NT=not tested; NB=no binding observed.

TABLE 22

Biacore ™ Binding Affinities of Hybridoma mAbs (H1M and H2M) Binding at 25° C./Antibody-Capture Format

| Antibody | ka ($Ms^{-1}$) | kd ($s^{-1}$) | $K_D$ (Molar) | T½+12(min) |
|---|---|---|---|---|
| H2M2689N | 7.73E+05 | 3.23E−03 | 4.18E−09 | 4 |
| H2M2690N | 9.70E+03 | 2.02E−04 | 2.09E−08 | 57 |
| H2M2691N | 1.03E+04 | 2.07E−04 | 2.01E−08 | 56 |
| H1M2692N™ | 8.05E+03 | 4.34E−04 | 5.39E−08 | 27 |
| H2M2704N | 3.46E+04 | 6.92E−04 | 2.00E−08 | 17 |
| H2M2705N | 6.62E+04 | 9.10E−04 | 1.37E−08 | 13 |
| H2M2706N | 3.29E+04 | 4.44E−03 | 1.35E−07 | 3 |
| H2M2707N | 2.95E+04 | 1.87E−03 | 6.35E−08 | 6 |
| H2M2708N | 6.94E+04 | 6.12E−04 | 8.82E−09 | 19 |
| H2M2709N | NT | NT | NT | NT |
| H2M2710N | 6.72E+04 | 7.53E−04 | 1.12E−08 | 15 |
| H2M2711N | 6.72E+04 | 7.67E−04 | 1.14E−08 | 15 |
| H1M2712N | 9.32E+03 | 2.19E−04 | 2.35E−08 | 53 |
| H2M2774N | 7.79E+04 | 9.18E−04 | 1.18E−08 | 13 |
| H2M2775N | 6.97E+04 | 6.26E−04 | 8.98E−09 | 18 |
| H2M2776N | 6.29E+04 | 6.39E−04 | 1.02E−08 | 18 |
| H2M2777N | 3.70E+04 | 1.63E−03 | 4.39E−08 | 7 |
| H2M2778N | 2.13E+04 | 1.89E−04 | 8.90E−09 | 61 |
| H2M2779N | 2.18E+04 | 2.28E−04 | 1.05E−08 | 51 |
| H2M2789N | NT | NT | NT | NT |
| H2M2862N | 3.72E+04 | 3.00E−03 | 8.07E−08 | 4 |
| H2M2885N | 6.82E+04 | 6.51E−04 | 9.54E−09 | 18 |
| H2M2886N | 7.29E+04 | 6.53E−04 | 8.96E−09 | 18 |
| H2M3540N | 3.77E+04 | 6.11E−04 | 1.62E−08 | 19 |
| H2M3541N | 7.10E+03 | 1.35E−03 | 1.89E−07 | 9 |
| H1M3542N | 2.37E+04 | 5.08E−04 | 2.14E−08 | 23 |
| H2M3543N | 7.53E+03 | 2.26E−04 | 3.00E−08 | 51 |
| H1M3544N | 9.69E+03 | 1.42E−04 | 1.46E−08 | 82 |
| H2M3547N | 2.18E+04 | 3.47E−04 | 1.59E−08 | 33 |
| H2M3548N | 3.87E+04 | 5.04E−03 | 1.30E−07 | 2 |
| H1M3549N | 1.18E+04 | 9.19E−04 | 7.76E−08 | 13 |
| H2M3563N | 3.24E+04 | 1.19E−04 | 3.66E−09 | 97 |
| H1M3613N | 1.93E+04 | 3.04E−04 | 1.57E−08 | 38 |

TABLE 23

Biacore ™ Binding Affinities of Hybridoma mAbs (H1M and H2M) Binding at 25° C./Antigen-Capture Format

| Antibody | ka ($Ms^{-1}$) | kd ($s^{-1}$) | $K_D$ (Molar) | T½ (min) |
|---|---|---|---|---|
| H2M2689N | 1.71E+06 | 9.97E−05 | 5.83E−11 | 116 |
| H2M2690N | 7.51E+04 | 6.35E−06 | 7.99E−11 | 1820 |
| H2M2691N | 3.94E+04 | 9.98E−06 | 2.54E−10 | 1158 |
| H1M2692N | 4.19E+04 | 9.90E−06 | 2.38E−10 | 1167 |
| H2M2704N | 1.32E+06 | 2.48E−04 | 1.87E−10 | 47 |
| H2M2705N | 2.43E+06 | 3.41E−04 | 1.40E−10 | 34 |
| H2M2706N | 5.63E+05 | 3.06E−04 | 5.44E−10 | 38 |
| H2M2707N | 3.99E+05 | 2.85E−04 | 7.15E−10 | 41 |
| H2M2708N | 1.73E+06 | 2.27E−04 | 1.31E−10 | 51 |
| H2M2709N | NT | NT | NT | NT |
| H2M2710N | 1.59E+06 | 2.43E−04 | 1.53E−10 | 48 |
| H2M2711N | 1.59E+06 | 2.40E−04 | 1.51E−10 | 48 |
| H1M2712N | 4.75E+04 | 1.37E−05 | 2.95E−10 | 846 |
| H2M2774N | 2.49E+06 | 3.36E−04 | 1.35E−10 | 34 |
| H2M2775N | 1.56E+06 | 2.16E−04 | 1.38E−10 | 53 |
| H2M2776N | 1.58E+06 | 2.22E−04 | 1.40E−10 | 52 |
| H2M2777N | 5.80E+05 | 3.21E−04 | 5.54E−10 | 36 |
| H2M2778N | 1.50E+05 | 6.57E−06 | 4.68E−11 | 1758 |
| H2M2779N | 1.28E+05 | 1.23E−05 | 9.38E−11 | 941 |
| H2M2789N | NT | NT | NT | NT |
| H2M2862N | 5.91E+05 | 3.21E−04 | 5.41E−10 | 36 |
| H2M2885N | 1.37E+06 | 1.52E−04 | 1.11E−10 | 76 |
| H2M2886N | 1.42E+06 | 1.36E−04 | 9.56E−11 | 85 |
| H2M3540N | 2.55E+06 | 5.87E−04 | 2.31E−10 | 20 |
| H2M3541N | 8.40E+04 | 1.16E−03 | 1.38E−08 | 10 |
| H1M3542N | 4.37E+05 | 2.00E−04 | 4.57E−10 | 58 |
| H2M3543N | 1.22E+05 | 7.96E−05 | 6.53E−10 | 145 |
| H1M3544N | 5.74E+04 | 5.98E−05 | 1.04E−09 | 193 |
| H2M3547N | 4.70E−05 | 1.00E−05 | 2.15E−11 | 1155 |
| H2M3548N | NT | NT | NT | NT |
| H1M3549N | 2.81E+05 | 2.89E−04 | 1.03E−09 | 40 |
| H2M3563N | 6.16E+05 | 4.77E−05 | 7.73E−11 | 242 |
| H1M3613N | 2.20E+05 | 9.60E−05 | 4.35E−10 | 120 |

TABLE 24

Biacore ™ Binding Affinities of Human Fc mAbs (H1H) Binding at 25° C./Antibody-Capture Format

| Antibody | ka ($Ms^{-1}$) | kd ($s^{-1}$) | $K_D$ (Molar) | T½ (min) |
|---|---|---|---|---|
| H1H2690N | NT | NT | NT | NT |
| H1H2712N | 3.06E+03 | 2.70E−04 | 8.82E−08 | 43 |

TABLE 24-continued

| Biacore ™ Binding Affinities of Human Fc mAbs (H1H) Binding at 25° C./Antibody-Capture Format | | | | |
|---|---|---|---|---|
| Antibody | ka ($Ms^{-1}$) | kd ($s^{-1}$) | $K_D$ (Molar) | T½ (min) |
| H1H5751P | 4.01E+03 | 5.18E−04 | 1.29E−07 | 22 |
| H1H5752P | NB | NB | NB | NB |
| H1H5753B | NT | NT | NT | NT |
| H1H5755B | 8.21E+03 | 4.72E−04 | 5.75E−08 | 24 |
| H1H5756B | 8.15E+03 | 2.66E−04 | 3.26E−08 | 43 |
| H1H5757B | 6.63E+03 | 7.85E−04 | 1.18E−07 | 15 |
| H1H5758B | 5.02E+03 | 1.17E−03 | 2.33E−07 | 10 |
| H1H5761P | 4.72E+03 | 2.44E−02 | 5.16E−06 | 0 |
| H1H5763P | 1.85E+04 | 5.40E−02 | 2.92E−06 | 0 |
| H1H5764P | 4.16E+03 | 1.59E−02 | 3.82E−06 | 1 |
| H1H5769P | 7.80E+03 | 9.41E−04 | 1.21E−07 | 12 |
| H1H5771P | 3.00E+04 | 6.26E−04 | 2.09E−08 | 18 |
| H1H5772S | 1.56E+04 | 1.55E−03 | 9.96E−08 | 7 |
| H1H5777P | 1.35E+04 | 3.02E−03 | 2.24E−07 | 4 |
| H1H5778P | 5.52E+03 | 1.54E−04 | 2.78E−08 | 75 |
| H1H5780P | 1.31E+04 | 3.99E−04 | 3.04E−08 | 29 |
| H1H5781P | 8.61E+03 | 4.97E−04 | 5.77E−08 | 23 |
| H1H5782P | NB | NB | NB | NB |
| H1H5785B | NT | NT | NT | NT |
| H1H5786B | 1.26E+04 | 1.08E−03 | 8.54E−08 | 11 |
| H1H5788P | 2.88E+03 | 2.91E−04 | 1.01E−07 | 40 |
| H1H5790B | 1.82E+04 | 5.17E−04 | 2.83E−08 | 22 |
| H1H5791B | 1.09E+04 | 7.90E−04 | 7.25E−08 | 15 |
| H1H5792B | NT | NT | NT | NT |
| H1H5793B | 8.54E+03 | 3.82E−04 | 4.47E−08 | 30 |
| H1H5795B | 1.73E+04 | 5.76E−04 | 3.33E−08 | 20 |
| H1H5796B | 1.47E+04 | 8.91E−04 | 6.05E−08 | 13 |
| H1H5797B | NT | NT | NT | NT |
| H1H5798B | NT | NT | NT | NT |
| H1H5799P | 1.36E+04 | 7.88E−03 | 5.79E−07 | 1 |
| H1H5801B | 6.57E+03 | 1.62E−03 | 2.46E−07 | 7 |
| OKT3 | 2.10E+06 | 2.00E+00 | 1.00E−06 | 0.35 sec |

TABLE 25

| Biacore ™ Binding Affinities of Human Fc mAbs (H1H) Binding at 25° C./Antigen-Capture Format | | | | |
|---|---|---|---|---|
| Antibody | ka ($Ms^{-1}$) | kd ($s^{-1}$) | $K_D$ (Molar) | T½ (min) |
| H1H2690N | NT | NT | NT | NT |
| H1H2712N | 8.93E+04 | 8.68E−05 | 9.71E−10 | 133 |
| H1H5751P | 7.24E+04 | 2.47E−04 | 3.42E−09 | 47 |
| H1H5752P | NB | NB | NB | NB |
| H1H5753B | NT | NT | NT | NT |
| H1H5755B | 2.15E+05 | 2.01E−04 | 9.36E−10 | 57 |
| H1H5756B | 1.44E+05 | 1.11E−04 | 7.67E−10 | 105 |
| H1H5757B | 1.80E+05 | 2.95E−04 | 1.64E−09 | 39 |
| H1H5758B | 1.42E+05 | 5.62E−04 | 3.97E−09 | 21 |
| H1H5761P | 2.11E+05 | 1.13E−02 | 5.34E−08 | 1 |
| H1H5763P | 1.84E+05 | 1.70E−02 | 9.24E−08 | 1 |
| H1H5764P | 3.50E+05 | 7.36E−03 | 2.10E−08 | 2 |
| H1H5769P | 1.19E+05 | 5.23E−04 | 4.41E−09 | 22 |
| H1H5771P | 9.23E+05 | 3.42E−04 | 3.71E−10 | 34 |
| H1H5772S | 5.19E+05 | 8.69E−04 | 1.67E−09 | 13 |
| H1H5777P | 4.83E+05 | 1.70E−03 | 3.52E−09 | 7 |
| H1H5778P | 3.99E+05 | 3.42E−05 | 8.56E−11 | 338 |
| H1H5780P | 4.78E+05 | 1.71E−04 | 3.58E−10 | 68 |
| H1H5781P | 1.40E+05 | 2.68E−04 | 1.92E−09 | 43 |
| H1H5782P | NB | NB | NB | NB |
| H1H5785B | NT | NT | NT | NT |
| H1H5786B | 3.00E+06 | 4.24E−04 | 1.41E−10 | 27 |
| H1H5788P | 7.06E+04 | 1.64E−04 | 2.33E−09 | 70 |
| H1H5790B | 9.25E+05 | 2.36E−04 | 2.54E−10 | 49 |
| H1H5791B | 7.86E+05 | 3.40E−04 | 4.33E−10 | 34 |
| H1H5792B | NT | NT | NT | NT |
| H1H5793B | 4.78E+05 | 1.59E−04 | 3.33E−10 | 73 |
| H1H5795B | 1.58E+06 | 2.29E−04 | 1.45E−10 | 50 |
| H1H5796B | 1.05E+05 | 2.44E−04 | 2.32E−09 | 47 |
| H1H5797B | NT | NT | NT | NT |
| H1H5798B | NT | NT | NT | NT |
| H1H5799P | 7.18E+05 | 5.64E−03 | 7.85E−09 | 2 |

TABLE 25-continued

| Biacore ™ Binding Affinities of Human Fc mAbs (H1H) Binding at 25° C./Antigen-Capture Format | | | | |
|---|---|---|---|---|
| Antibody | ka ($Ms^{-1}$) | kd ($s^{-1}$) | $K_D$ (Molar) | T½ (min) |
| H1H5801B | 3.31E+05 | 1.12E−03 | 3.38E−09 | 10 |
| OKT3 | 3.94E+06 | 2.18E−02 | 5.53E−09 | 0.5 |

TABLE 26

| Biacore ™ Binding Affinities of monovalent 1-arm mAbs Binding at 25° C./Antibody-Capture Format | | | | |
|---|---|---|---|---|
| Antibody | ka ($Ms^{-1}$) | kd ($s^{-1}$) | $K_D$ (Molar) | T½ (min) |
| H1H7194P | 1.16E+04 | 1.51E−04 | 1.30E−08 | 76 |
| H1H7195P | 3.13E+04 | 9.89E−05 | 3.16E−09 | 117 |
| H1H7196P | 1.07E+04 | 4.43E−04 | 4.13E−08 | 26 |
| H1H7198P | 2.63E+04 | 1.58E−04 | 6.02E−09 | 73 |
| H1H7203P | 1.46E+04 | 2.67E−04 | 1.83E−08 | 43 |
| H1H7204P | 1.43E+04 | 3.62E−04 | 2.53E−08 | 32 |
| H1H7208P | NT | NT | NT | NT |
| H1H7211P | 1.41E+04 | 1.59E−04 | 1.13E−08 | 73 |
| H1H7221P | 1.07E+04 | 2.92E−04 | 2.75E−08 | 40 |
| H1H7223P | 1.60E+04 | 3.07E−04 | 1.92E−08 | 38 |
| H1H7226P | 1.30E+04 | 3.55E−04 | 2.72E−08 | 33 |
| H1H7232P | 8.03E+03 | 1.77E−03 | 2.20E−07 | 7 |
| H1H7233P | 1.11E+04 | 2.69E−04 | 2.42E−08 | 43 |
| H1H7241P | 1.34E+04 | 2.95E−04 | 2.20E−08 | 39 |
| H1H7242P | 2.15E+04 | 6.64E−04 | 3.09E−08 | 17 |
| H1H7250P | 2.34E+04 | 2.47E−04 | 1.05E−08 | 47 |
| H1H7251P | 2.56E+04 | 1.07E−03 | 4.17E−08 | 11 |
| H1H7254P | 2.60E+04 | 3.88E−04 | 1.49E−08 | 30 |
| H1H7258P | 1.26E+04 | 3.02E−04 | 2.40E−08 | 38 |
| H1H7269P | 2.57E+04 | 6.24E−03 | 2.43E−07 | 2 |
| H1H7279P | NB | NB | NB | NB |
| H1xH7221G | NT | NT | NT | NT |
| H1xH7221G3 | NB | NB | NB | NB |
| H1xH7221G5 | NB | NB | NB | NB |

TABLE 27

| Biacore ™ Binding Affinities of monovalent 1-arm mAbs Binding at 25° C./Antigen-Capture Format | | | | |
|---|---|---|---|---|
| Antibody | ka ($Ms^{-1}$) | kd ($s^{-1}$) | $K_D$ (Molar) | T½ (min) |
| H1H7194P | 3.50E+05 | 8.43E−05 | 2.41E−10 | 137 |
| H1H7195P | 5.66E+05 | 7.14E−05 | 1.26E−10 | 162 |
| H1H7196P | 1.85E+05 | 4.61E−04 | 2.49E−09 | 25 |
| H1H7198P | 6.28E+05 | 7.07E−05 | 1.12E−10 | 163 |
| H1H7203P | 4.79E+05 | 2.38E−04 | 4.98E−10 | 48 |
| H1H7204P | 1.73E+05 | 3.65E−04 | 2.12E−09 | 32 |
| H1H7208P | NT | NT | NT | NT |
| H1H7211P | 3.45E+05 | 9.61E−05 | 2.79E−10 | 120 |
| H1H7221P | 1.36E+05 | 2.39E−04 | 1.75E−09 | 48 |
| H1H7223P | 1.87E+05 | 2.86E−04 | 1.53E−09 | 40 |
| H1H7226P | 4.18E+05 | 2.36E−04 | 5.65E−10 | 49 |
| H1H7232P | 1.49E+05 | 1.49E−03 | 1.00E−08 | 8 |
| H1H7233P | 1.61E+05 | 2.04E−04 | 1.27E−09 | 57 |
| H1H7241P | 1.87E+05 | 2.36E−04 | 1.26E−09 | 49 |
| H1H7242P | 3.83E+05 | 1.01E−03 | 2.63E−09 | 11 |
| H1H7250P | 2.31E+05 | 1.89E−04 | 8.20E−10 | 61 |
| H1H7251P | 4.47E+05 | 1.19E−03 | 2.67E−09 | 10 |
| H1H7254P | 4.33E+05 | 3.30E−04 | 7.62E−10 | 35 |
| H1H7258P | 1.33E+05 | 2.90E−04 | 2.18E−09 | 40 |
| H1H7269P | 2.77E+05 | 6.89E−03 | 2.49E−08 | 2 |
| H1H7279P | NB | NB | NB | NB |
| H1xH7221G | NT | NT | NT | NT |
| H1xH7221G3 | NB | NB | NB | NB |
| H1xH7221G5 | NB | NB | NB | NB |

As shown in Tables 22-27, Several anti-CD3 antibodies of the present invention bind CD3, in either antibody-capture or antigen-capture formats, with high affinity.

Example 14

Anti-CD3 Antibodies Bind and Proliferate Human T-Cells

Anti-CD3 antibodies of the present invention were tested for their ability to bind to human T-cells and induce their proliferation. Binding was assessed using Jurkat cells (a CD3+ human T-cell line), while proliferation of Peripheral Blood Mononuclear Cells (PBMC) was assessed using ATP catalyzed quantification (CellTiter Glo®). Anti-CD3 antibody OKT3 acted as a positive control and irrelevant isotype matched antibodies served as negative controls.

FACS data was acquired using the following protocol: Cells at $2\times10^5$ per well were incubated with serially diluted antibodies for 30 min on ice. Post incubation, cells were washed and secondary antibody was added and incubated for an additional 30 minutes. After incubation, cells were washed, re-suspended in cold PBS containing 1% BSA and analyzed by flow cytometry with viable Jurkat cells gated by side and forward scatters. The $EC_{50}$s for cell binding titration were determined using Prism software with values calculated using a 4-parameter non-linear regression analysis.

Proliferation data was acquired using the following protocol: Human PBMC ($5\times10^4$/well) were incubated with a 3-fold serial dilution of anti-CD3 and a fixed concentration of a commercial anti-CD28 antibody (200 ng/ml) in 96 well plates for 72 h at 37° C. Following incubation, CellTiter Glo® was added and luminescence was measured using a VICTOR ×5 multi-label plate reader (Perkin Elmer). The $EC_{50}$ of cell viability (ATP catalyzed quantification) was calculated using a 4-parameter non-linear regression analysis in GraphPad Prism.

Results of the binding and proliferation experiments are summarized in Tables 28-30.

TABLE 28

Hybridoma Anti-CD3 mAbs Bind & Proliferate Human T-Cells

| Antibody | $EC_{50}$ [M] FACS JURKAT | $EC_{50}$ [M] hPBMC Proliferation |
|---|---|---|
| H2M2689N | NB | 0.00E+00 |
| H2M2690N | 4.37E−09 | 5.37E−12 |
| H2M2691N | 6.77E−09 | 3.43E−11 |
| H1M2692N | 5.99E−09 | 1.42E−10 |
| H2M2704N | 8.45E−10 | 2.93E−12 |
| H2M2705N | 2.96E−10 | 1.76E−11 |
| H2M2706N | 2.37E−09 | 3.86E−12 |
| H2M2707N | 1.24E−07 | 1.92E−12 |
| H2M2708N | 6.58E−10 | 2.69E−08 |
| H2M2709N | 7.11E−10 | 2.48E−11 |
| H2M2710N | 7.10E−10 | 2.11E−10 |
| H2M2711N | 1.16E−09 | 6.48E−10 |
| H1M2712N | 2.19E−08 | 1.28E−10 |
| H2M2774N | 3.52E−10 | 4.92E−10 |
| H2M2775N | 1.32E−09 | 1.09E−09 |
| H2M2776N | 4.91E−10 | 2.84E−11 |
| H2M2777N | 2.16E−09 | 2.51E−11 |
| H2M2778N | 3.62E−09 | 0.00E+00 |
| H2M2779N | NT | 0.00E+00 |
| H2M2789N | NT | 2.85E−08 |
| H2M2862N | 7.68E−09 | 6.72E−13 |
| H2M2885N | 2.09E−09 | 2.49E−12 |
| H2M2886N | 3.97E−09 | 2.69E−12 |
| H2M3540N | 3.99E−09 | 3.16E−12 |
| H2M3541N | 3.70E−09 | 6.40E−12 |
| H1M3542N | 2.01E−09 | 0.00E+00 |
| H2M3543N | 5.63E−09 | 6.12E−12 |
| H1M3544N | 2.32E−08 | 0.00E+00 |
| H2M3547N | 2.71E−09 | 5.02E−12 |

TABLE 28-continued

Hybridoma Anti-CD3 mAbs Bind & Proliferate Human T-Cells

| Antibody | $EC_{50}$ [M] FACS JURKAT | $EC_{50}$ [M] hPBMC Proliferation |
|---|---|---|
| H2M3548N | 1.10E−09 | 1.89E−12 |
| H1M3549N | 2.30E−09 | 0.00E+00 |
| H2M3563N | 1.07E−09 | 7.74E−12 |
| H1M3613N | 1.03E−08 | 0.00E+00 |
| Isotype Ctrl | NB | 0.00E+00 |

NB: No Binding;
NT: Not Tested

TABLE 29

Human Fc Anti-CD3 mAbs Bind & Proliferate Human T-Cells

| Antibody | $EC_{50}$ [M] FACS JURKAT | $EC_{50}$ [M] hPBMC Proliferation |
|---|---|---|
| H1H5751P | 2.12E−09 | 9.29E−12 |
| H1H5752P | 3.43E−10 | 1.09E−12 |
| H1H5753B | NB | 9.14E−11 |
| H1H5755B | 1.23E−09 | 4.24E−12 |
| H1H5756B | NB | 0.00E+00 |
| H1H5757B | 3.38E−09 | 4.86E−12 |
| H1H5758B | 1.90E−09 | 2.13E−12 |
| H1H5761P | 2.10E−09 | 3.62E−13 |
| H1H5763P | 2.76E−09 | 3.11E−13 |
| H1H5764P | 8.80E−10 | 3.27E−13 |
| H1H5769P | 4.10E−09 | 6.17E−12 |
| H1H5771P | NT | 6.35E−12 |
| H1H5772S | 6.64E−10 | 4.42E−12 |
| H1H5777P | 5.71E−10 | 3.04E−12 |
| H1H5778P | 6.85E−10 | 5.04E−12 |
| H1H5780P | 7.62E−10 | 3.44E−12 |
| H1H5781P | 1.23E−09 | 6.08E−12 |
| H1H5782P | NB | 5.17E−12 |
| H1H5785B | NB | 0.00E+00 |
| H1H5786B | 1.10E−09 | 1.79E−12 |
| H1H5788P | 3.53E−09 | 4.62E−12 |
| H1H5790B | 3.55E−09 | 2.71E−12 |
| H1H5791B | 3.77E−09 | 1.75E−12 |
| H1H5792B | 5.87E−09 | 6.47E−12 |
| H1H5793B | 4.62E−09 | 3.28E−12 |
| H1H5795B | 2.04E−09 | 3.09E−12 |
| H1H5796B | 9.82E−09 | 4.37E−12 |
| H1H5797B | 3.96E−08 | 1.07E−11 |
| H1H5798B | 5.57E−09 | 2.59E−12 |
| H1H5799P | NT | 1.63E−13 |
| H1H5801B | 1.55E−08 | 1.09E−12 |
| OKT3 | 1.96E−10 | 3.30E−13 |
| Isotype Ctrl | NB | 0.00E+00 |

NB: No Binding;
NT: Not Tested

TABLE 30

Monovalent 1-arm Anti-CD3 mAbs Bind & Proliferate Human T-Cells

| Antibody | $EC_{50}$ [M] FACS JURKAT | $EC_{50}$ [M] hPBMC Proliferation |
|---|---|---|
| H1H7194P | 1.50E−09 | 2.37E−12 |
| H1H7195P | 3.42E−10 | 2.42E−12 |
| H1H7196P | 3.44E−08 | 1.27E−12 |
| H1H7198P | 7.26E−10 | 2.55E−12 |
| H1H7203P | 3.24E−09 | 1.64E−12 |
| H1H7204P | 2.29E−09 | 1.51E−12 |
| H1H7208P | 5.19E−08 | 1.46E−12 |
| H1H7211P | 7.01E−10 | 2.75E−12 |
| H1H7221P | 1.40E−09 | 2.60E−12 |
| H1H7223P | 9.37E−10 | 1.07E−12 |
| H1H7226P | 7.95E−10 | 9.52E−13 |

TABLE 30-continued

| Monovalent 1-arm Anti-CD3 mAbs Bind & Proliferate Human T-Cells | | |
|---|---|---|
| Antibody | $EC_{50}$ [M] FACS JURKAT | $EC_{50}$ [M] hPBMC Proliferation |
| H1H7232P | 1.50E−09 | 1.03E−12 |
| H1H7233P | 7.15E−10 | 7.34E−13 |
| H1H7241P | 1.01E−09 | 1.05E−12 |
| H1H7242P | 1.83E−09 | 2.13E−12 |
| H1H7250P | 1.37E−09 | 2.43E−12 |
| H1H7251P | 1.45E−09 | 1.30E−12 |
| H1H7254P | 1.09E−09 | 2.80E−12 |
| H1H7258P | 1.07E−09 | 2.17E−12 |
| H1H7269P | 1.95E−09 | 1.15E−12 |
| H1H7279P | NB | 0.00E+00 |
| Isotype Ctrl | NB | 0.00E+00 |

NB: No Binding;
NT: Not Tested

As shown in Tables 7-9, the vast majority of anti-CD3 antibodies of the invention bound human T-cells and induced T-cell proliferation.

Example 15

Anti-CD3 Antibodies Bind and Proliferate Monkey T-Cells

A subset of anti-CD3 antibodies of the invention was tested for the ability to bind to and induce proliferation of monkey T-cells.

FACS data was acquired using the following protocol: Cells at $2\times10^5$ per well were incubated with serially diluted antibodies for 30 min on ice. Post incubation, cells were washed and secondary antibodies were added and incubated for an additional 30 minutes. After incubation, cells were washed, re-suspended in cold PBS containing 1% BSA and analyzed by flow cytometry. CD4+ monkey T cells were gated by side and forward scatters, and on the CD2+CD4+ CD20− population. The $EC_{50}$s for cell binding titration were calculated using a 4-parameter non-linear regression analysis in GraphPad Prism.

Proliferation data was acquired using the following protocol: Freshly isolated cynomolgus monkey derived PBMC ($5\times10^4$/well) were incubated with a 3-fold serial dilution of anti-CD3 antibody and a fixed concentration of a commercial anti-CD28 antibody (500 ng/ml) antibody in 96 well plates for 72 h at 37° C. Following incubation, CellTiter Glo® was added and luminescence was measured using a VICTOR ×5 multi-label plate reader (PerkinElmer). The $EC_{50}$ of cell viability (ATP catalyzed quantification) was calculated using a 4-parameter non-linear regression analysis in GraphPad Prism.

Results of the binding and proliferation experiments are summarized in Tables 31 and 32.

TABLE 31

| Anti-CD3 mAbs Bind & Proliferate monkey PBMCs | | |
|---|---|---|
| Antibody | EC50 [M] FACS PBMCs | EC50 [M] mfPBMC Proliferation |
| H1H2690N | 5.66E−09 | 2.71E−12 |
| H1H2712N | 2.29E−09 | 2.72E−12 |
| H2M3547N | 1.12E−10 | NT |
| H2M3563N | 1.65E−10 | NT |
| H1H5761P | NT | 2.81E−09 |
| H1H5763P | NT | 0.00E+00 |
| H1H5764P | NT | 4.06E−10 |
| H1H5769P | NT | 8.33E−13 |
| H1H5771P | NT | 2.74E−12 |
| H1H5772S | NT | 1.47E−12 |
| H1H5778P | NT | 5.93E−13 |
| H1H5780P | NT | 3.13E−13 |
| H1H5781P | NT | 7.92E−13 |
| H1H5788P | NT | 2.01E−12 |
| OKT3 | NB | NT |
| SP34 | 7.03E−11 | 1.71E−12 |

NB: No Binding;
NT: not tested

TABLE 32

| Monovalent 1-arm Anti-CD3 mAbs Bind & Proliferate Monkey PBMCs | | |
|---|---|---|
| Antibody | EC50 [M] FACS PBMCs | EC50 [M] mfPBMC Proliferation |
| H1H7194P | NT | 4.84E−12 |
| H1H7195P | NT | 1.36E−12 |
| H1H7196P | NT | 1.40E−08 |
| H1H7198P | NT | 2.29E−12 |
| H1H7203P | NT | 4.97E−13 |
| H1H7204P | NT | 1.26E−11 |
| H1H7208P | NT | 7.02E−12 |
| H1H7211P | NT | 2.81E−13 |
| H1H7221P | NT | 1.72E−12 |
| H1H7223P | NT | 6.75E−11 |
| H1H7226P | NT | 2.26E−11 |
| H1H7232P | NT | 4.90E−11 |
| H1H7233P | NT | 4.35E−12 |
| H1H7241P | NT | 2.05E−11 |
| H1H7242P | NT | 1.38E−11 |
| H1H7250P | NT | 7.27E−11 |
| H1H7251P | NT | 1.83E−11 |
| H1H7254P | NT | 8.88E−11 |
| H1H7258P | NT | 1.11E−11 |

NB: No Binding;
NT: not tested

As shown in Tables 31 and 32, several anti-CD3 antibodies of the invention bound CD2+CD4+ monkey T-cells and induced their proliferation. OKT3 did not drive monkey PBMC proliferation, while SP34 was active against monkey PBMCs.

Example 16

Anti-CD3 mAbs Support T-Cell-Mediated Killing of Tumor Cells

The ability of anti-CD3 antibodies to redirect T-cell mediated killing via Fc/FcR interactions was studied using a calcein based U937 killing assay. Briefly, human PBMC were isolated over Ficoll-Paque and activated over a course of several days with media containing human IL-2 (30 U/ml) and T-cell activation beads (anti-CD3/CD28). U937 cells were labeled with calcein, and then incubated with activated T-cells at a 10:1 effector: target ratio using 3-fold serial dilutions of antibodies over a course of 3 hours at 37° C. Following incubation, the plates were centrifuged and supernatants were transferred to a translucent black clear bottom plate for fluorescence analysis. $EC_{50}$ values, defined as the molar concentration of CD3 antibody that induces 50% cytotoxicity, were calculated using a 4-parameter non-linear regression analysis in GraphPad Prism. Results using hybridoma antibodies, human Fc antibodies, and monovalent one-arm antibodies are shown in Tables 33, 34 and 35, respectively.

TABLE 33

Hybridoma Anti-CD3 mAbs Redirect T-Cell Killing to U937 Cells

| Antibody | U937 Cytotoxicity Human T-cells [M] |
|---|---|
| H2M2689N | 0.00E+00 |
| H2M2690N | 2.79E−11 |
| H2M2691N | 2.34E−11 |
| H1M2692N | 3.59E−10 |
| H2M2704N | 2.49E−12 |
| H2M2705N | 1.73E−12 |
| H2M2706N | 7.91E−12 |
| H2M2707N | 7.21E−12 |
| H2M2708N | 3.27E−12 |
| H2M2709N | 3.47E−12 |
| H2M2710N | 3.97E−12 |
| H2M2711N | 3.66E−12 |
| H1M2712N | 3.14E−10 |
| H2M2774N | 2.46E−12 |
| H2M2775N | 3.38E−12 |
| H2M2776N | 4.06E−12 |
| H2M2777N | 4.86E−12 |
| H2M2778N | 0.00E+00 |
| H2M2779N | 6.75E−10 |
| H2M2789N | NT |
| H2M2862N | 7.66E−12 |
| H2M2885N | 3.71E−12 |
| H2M2886N | 8.06E−12 |
| H2M3540N | 1.25E−11 |
| H2M3541N | 5.39E−11 |
| H1M3542N | 2.92E−11 |
| H2M3543N | 1.31E−11 |
| H1M3544N | 1.72E−10 |
| H2M3547N | 3.17E−11 |
| H2M3548N | 5.50E−12 |
| H1M3549N | 1.07E−10 |
| H2M3563N | 4.05E−11 |
| H1M3613N | 8.66E−10 |
| Isotype Ctrl | 0.00E+00 |

NT: Not Tested

TABLE 34

Human Fc formatted Anti-CD3 mAbs Redirect T-Cell Killing to U937 Cells

| Antibody | U937 Cytotoxicity Human T-cells [M] |
|---|---|
| H1H5751P | 1.30E−10 |
| H1H5752P | 1.85E−11 |
| H1H5753B | 3.79E−10 |
| H1H5755B | 5.16E−11 |
| H1H5756B | 7.69E−11 |
| H1H5757B | 9.65E−11 |
| H1H5758B | 8.86E−08 |
| H1H5761P | 2.00E−12 |
| H1H5763P | NT |
| H1H5764P | NT |
| H1H5769P | 5.65E−11 |
| H1H5771P | NT |
| H1H5772S | 6.89E−13 |
| H1H5777P | 4.87E−13 |
| H1H5778P | 3.41E−13 |
| H1H5780P | 4.03E−12 |
| H1H5781P | 1.83E−12 |
| H1H5782P | 5.18E−12 |
| H1H5785B | 4.43E−11 |
| H1H5786B | 6.10E−11 |
| H1H5788P | 1.54E−11 |
| H1H5790B | 8.71E−11 |
| H1H5791B | 8.01E−11 |
| H1H5792B | 1.40E−10 |
| H1H5793B | 8.85E−11 |
| H1H5795B | 6.74E−11 |
| H1H5796B | 5.03E−10 |
| H1H5797B | 5.76E−10 |
| H1H5798B | 1.81E−10 |
| H1H5799P | NT |
| H1H5801B | 9.23E−11 |
| OKT3 | 2.35E−12 |
| Isotype Ctrl | 0.00E+00 |

NT: Not Tested

TABLE 35

Monovalent 1-arm Anti-CD3 mAbs Redirect T-Cell Killing to U937 Cells

| Antibody | U937 Cytotoxicity Human T-cells [M] |
|---|---|
| H1H7194P | 4.71E−12 |
| H1H7195P | 6.10E−12 |
| H1H7196P | 1.96E−11 |
| H1H7198P | 5.21E−12 |
| H1H7203P | 5.47E−12 |
| H1H7204P | 1.08E−11 |
| H1H7208P | 4.59E−11 |
| H1H7211P | 7.89E−12 |
| H1H7221P | 9.21E−12 |
| H1H7223P | 5.30E−12 |
| H1H7226P | 1.04E−11 |
| H1H7232P | 9.96E−12 |
| H1H7233P | 1.19E−11 |
| H1H7241P | 1.23E−11 |
| H1H7242P | 7.50E−12 |
| H1H7250P | 5.91E−12 |
| H1H7251P | 1.81E−12 |
| H1H7254P | 4.18E−12 |
| H1H7258P | 1.53E−11 |
| H1H7269P | 1.08E−11 |
| H1H7279P | 0.00E+00 |
| Isotype Ctrl | 0.00E+00 |

NT: Not Tested

As shown in Tables 33-35, most anti-CD3 antibodies, as well as OKT3, supported redirected T-cell mediated killing in this assay system. The observed killing, believed to be dependent on the antibody's Fc engagement with the Fc Receptor on U937 cells leading to clustering of CD3 on adjacent T-cells, was squelched by addition of non-specific human IgG (data not shown).

The present invention is not to be limited in scope by the specific embodiments described herein. Indeed, various modifications of the invention in addition to those described herein will become apparent to those skilled in the art from the foregoing description. Such modifications are intended to fall within the scope of the appended claims.

SEQUENCE LISTING (1686 sequences)

SEQ ID NO: 1 - DNA, 351 bp, Artificial Sequence
  synthetic
gagtttcaggtggtggagtctgggggaggcctggtcaagcctggggggtccctcagactctcctgtgtggtctccggattcaccttcagtaactataatatgaactgggtccgccaggctccagcgaagggactggagtgggtctcatccattagtactggtagtagtgacatttactacgcagactcagtgaagggccgattcaccatctccagagacaacgccaagaactcactgtatctgcaaatgaacagcctgagagtcgaggacacggctgtttattactgtgcgagagatataattggaactacgagggactggggccagggaaccctggtcaccgtctcctca

SEQ ID NO: 2 - protein, 117 aa, Artificial Sequence
  synthetic
EFQVVESGGGLVKPGGSLRLSCVVSGFTFSNYNMNWVRQAPAKGLEWVSSISTGSSDIYYADSVKGRFTISRDNAKNSLYLQMNSLRVEDTAVYYCARDIIGTTRDWGQGTLVTVSS

SEQ ID NO: 3 - DNA, 24 bp, Artificial Sequence
  synthetic
ggattcaccttcagtaactataat

SEQ ID NO: 4 - protein, 8 aa, Artificial Sequence
  synthetic
GFTFSNYN

SEQ ID NO: 5 - DNA, 24 bp, Artificial Sequence
  synthetic
attagtactggtagtagtgacatt

SEQ ID NO: 6 - protein, 8 aa, Artificial Sequence
  synthetic
ISTGSSDI

SEQ ID NO: 7 - DNA, 30 bp, Artificial Sequence
  synthetic
gcgagagatataattggaactacgagggac

SEQ ID NO: 8 - protein, 10 aa, Artificial Sequence
  synthetic
ARDIIGTTRD

SEQ ID NO: 9 - DNA, 372 bp, Artificial Sequence
  synthetic
caggtgcagctggtggagtctgggggaggcgtggtccagcctgggaggtccctgagactctcctgtgcagcctctggattcaccttcagcagctatggcatgcactgggtccgccaacctccaggcaagggactggagtgggtggctattatgtcatatgatggaagtaataaatactatgcagattccgtgaagggccgattcaccatctccagagacaattccaagaacacgctgtatctgcagatgaatagcctgagagttgaggacacggctgtgtattactgtgcgaaagatcaatattacgattttttgacttttgactatacccttgactactggggccagggaaccctggtcaccgtctcctca

SEQ ID NO: 10 - protein, 124 aa, Artificial Sequence
  synthetic
QVQLVESGGGVVQPGRSLRLSCAASGFTFSSYGMHWVRQPPGKGLEWVAIMSYDGSNKYYADSVKGRFTISRDNSKNTLYLQMNSLRVEDTAVYYCAKDQYYDFLTFDYTLDYWGQGTLVTVSS

SEQ ID NO: 11 - DNA, 24 bp, Artificial Sequence
  synthetic
ggattcaccttcagcagctatggc

SEQ ID NO: 12 - protein, 8 aa, Artificial Sequence
  synthetic
GFTFSSYG

SEQ ID NO: 13 - DNA, 24 bp, Artificial Sequence
  synthetic
atgtcatatgatggaagtaataaa

SEQ ID NO: 14 - protein, 8 aa, Artificial Sequence
  synthetic
MSYDGSNK

SEQ ID NO: 15 - DNA, 51 bp, Artificial Sequence
  synthetic
gcgaaagatcaatattacgattttttgacttttgactatacccttgactac

SEQ ID NO: 16 - protein, 17 aa, Artificial Sequence
  synthetic
AKDQYYDFLTFDYTLDY

SEQ ID NO: 17 - DNA, 366 bp, Artificial Sequence
  synthetic
caggtgcagctggtggagtctgggggaggcgtggtccagcctgggaggtccctaagactctcctgtgcagcgtctggattctccttcagtggctatggcatgcactgggtccgccaggctccaggcaaggggctggagtgggtggcagttacatggtatgatggaagtaataaatactatgcagactccgtgaagggccgattcaccatctccagagacaattccaagaacacgctgtatctacaaatgaacagcctgagagccgaggacacggctgtgtattactgtgcgagagatggaaactgggggggtccctactggtacttcgatctctggggccgtggcaccctggtcaccgtctcctca

SEQ ID NO: 18 - protein, 122 aa, Artificial Sequence
  synthetic
QVQLVESGGGVVQPGRSLRLSCAASGFSFSGYGMHWVRQAPGKGLEWVAVTWYDGSNKYYADSVKGRFTISRDNSKNTLYLQMNSLRAEDTAVYYCARDGNWGGPYWYFDLWGRGTLVTVSS

SEQ ID NO: 19 - DNA, 24 bp, Artificial Sequence
  synthetic
ggattctccttcagtggctatggc

SEQ ID NO: 20 - protein, 8 aa, Artificial Sequence
  synthetic
GFSFSGYG

SEQ ID NO: 21 - DNA, 24 bp, Artificial Sequence
  synthetic
acatggtatgatggaagtaataaa

SEQ ID NO: 22 - protein, 8 aa, Artificial Sequence
  synthetic
TWYDGSNK

SEQ ID NO: 23 - DNA, 45 bp, Artificial Sequence
  synthetic
gcgagagatggaaactgggggggtccctactggtacttcgatctc

SEQ ID NO: 24 - protein, 15 aa, Artificial Sequence
  synthetic
ARDGNWGGPYWYFDL

SEQ ID NO: 25 - DNA, 372 bp, Artificial Sequence
  synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgctggaaataataaatactatgtagactccgtgaagggccgattcaccatctccagagacaattccaagaacacgctgtatctgcaaatgaacagcctgagagctgaggacacggctgtgtattactgtgcgaaagatccgtattacgattttttgactggttcggactactttgactactggggccagggaaccctggtcaccgtctcctca

SEQ ID NO: 26 - protein, 124 aa, Artificial Sequence
  synthetic
QVQLVESGGGVVQPGRSLRLSCAASGFTFSSYGMHWVRQAPGKGLEWVAVISYAGNNKYYVDSVKGRFTISRDNSKNTLYLQMNSLRAEDTAVYYCAKDPYYDFLTGSDYFDYWGQGTLVTVSS

SEQ ID NO: 27 - DNA, 24 bp, Artificial Sequence
  synthetic
ggattcaccttcagtagctatggc

SEQ ID NO: 28 - protein, 8 aa, Artificial Sequence
  synthetic
GFTFSSYG

SEQ ID NO: 29 - DNA, 24 bp, Artificial Sequence
  synthetic
atatcatatgctggaaataataaa

SEQ ID NO: 30 - protein, 8 aa, Artificial Sequence
  synthetic
ISYAGNNK

SEQ ID NO: 31 - DNA, 51 bp, Artificial Sequence
  synthetic
gcgaaagatccgtattacgattttttgactggttcggactactttgactac

SEQ ID NO: 32 - protein, 17 aa, Artificial Sequence
  synthetic
AKDPYYDFLTGSDYFDY

SEQ ID NO: 33 - DNA, 372 bp, Artificial Sequence
  synthetic
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaaataataaatactatgcagactccgtgaagggccgattcaccatctccagagacaattccaagaagacgctgtatctgcaaatgaccagcctgagagccgaggacacggctgtgtattactgtgcgagagatcagtattacgatattttgactgctgataacacccttgactactggggccagggaaccctggtcaccgtctcctca

SEQ ID NO: 34 - protein, 124 aa, Artificial Sequence
  synthetic
QVQLVESGGGVVQPGRSLRLSCAASGFTFSSYGMHWVRQAPGKGLEWVAVIWYDGNNKYYADSVKGRFTISRDNSKKTLYLQMTSLRAEDTAVYYCARDQYYDILTADNTLDYWGQGTLVTVSS

SEQ ID NO: 35 - DNA, 24 bp, Artificial Sequence
  synthetic
ggattcaccttcagtagctatggc

SEQ ID NO: 36 - protein, 8 aa, Artificial Sequence
  synthetic
GFTFSSYG

SEQ ID NO: 37 - DNA, 24 bp, Artificial Sequence
  synthetic
atatggtatgatggaaataataaa

SEQ ID NO: 38 - protein, 8 aa, Artificial Sequence
  synthetic
IWYDGNNK

SEQ ID NO: 39 - DNA, 51 bp, Artificial Sequence
  synthetic
gcgagagatcagtattacgatattttgactgctgataacacccttgactac

SEQ ID NO: 40 - protein, 17 aa, Artificial Sequence
  synthetic
ARDQYYDILTADNTLDY

SEQ ID NO: 41 - DNA, 375 bp, Artificial Sequence
  synthetic
caggtgcagctggtggagtctgggggaggcgtggtccagcctgggaggtccctgagactctcctgtgcagcctctggattcaccttcattagttatggcatgcactgggtccgccaggctccaggcaaggggctggagtgggtggcagttatatcatatgatggaagtaataaatactatgcagactccgtgaagggccgattcaccatctccagagacaattccaagaacacgctgtttctgcaaatgaacagcctgagagctgaggacacggctgtgtattactgtgcgaagaattacgatttttggaatggctatgttggctactacggtatggacgtctggggccaagggaccacggtcaccgtctcctca

SEQ ID NO: 42 - protein, 125 aa, Artificial Sequence
  synthetic
QVQLVESGGGVVQPGRSLRLSCAASGFTFISYGMHWVRQAPGKGLEWVAVISYDGSNKYYADSVKGRFTISRDNSKNTLFLQMNSLRAEDTAVYYCAKNYDFWNGYVGYYGMDVWGQGTTVTVSS

SEQ ID NO: 43 - DNA, 24 bp, Artificial Sequence
  synthetic
ggattcaccttcattagttatggc

SEQ ID NO: 44 - protein, 8 aa, Artificial Sequence
  synthetic
GFTFISYG

SEQ ID NO: 45 - DNA, 24 bp, Artificial Sequence
  synthetic
atatcatatgatggaagtaataaa

SEQ ID NO: 46 - protein, 8 aa, Artificial Sequence
  synthetic
ISYDGSNK

SEQ ID NO: 47 - DNA, 54 bp, Artificial Sequence
  synthetic
gcgaagaattacgatttttggaatggctatgttggctactacggtatggacgtc

SEQ ID NO: 48 - protein, 18 aa, Artificial Sequence
  synthetic
AKNYDFWNGYVGYYGMDV

SEQ ID NO: 49 - DNA, 351 bp, Artificial Sequence
  synthetic
gaggtgcagctggtggagtctgggggaggcttggtccagcctggggggtccctgagactctcctgtgtagtctctggattcacctttaataactattggatgagttgggtccgccaggctccagggaaggggctggagtgggtggccaacataaagaaagatggaagtgagaaatattatgtggactctgtgaagggccgattcaccatctccagagacaacgccaagaactcactgtatttgcaaatgaacagcctgagagccgaggacacggctgtatattactgtgcgagggatataatggctacgattatagactggggccagggaaccctggtcaccgtctcctca

SEQ ID NO: 50 - protein, 117 aa, Artificial Sequence
  synthetic
EVQLVESGGGLVQPGGSLRLSCVVSGFTFNNYWMSWVRQAPGKGLEWVANIKKDGSEKYYVDSVKGRFTISRDNAKNSLYLQMNSLRAEDTAVYYCARDIMATIIDWGQGTLVTVSS

SEQ ID NO: 51 - DNA, 24 bp, Artificial Sequence
  synthetic
ggattcacctttaataactattgg

SEQ ID NO: 52 - protein, 8 aa, Artificial Sequence
  synthetic
GFTFNNYW

SEQ ID NO: 53 - DNA, 24 bp, Artificial Sequence
  synthetic
ataaagaaagatggaagtgagaaa

SEQ ID NO: 54 - protein, 8 aa, Artificial Sequence
  synthetic
IKKDGSEK

SEQ ID NO: 55 - DNA, 30 bp, Artificial Sequence
  synthetic
gcgagggatataatggctacgattatagac

SEQ ID NO: 56 - protein, 10 aa, Artificial Sequence
  synthetic
ARDIMATIID

SEQ ID NO: 57 - DNA, 369 bp, Artificial Sequence
  synthetic
caggtgcagctggtggagtccgggggaggcgtggtccagcctgggaggtccctgagactctcctgtgcagcctctggattcccctttaatagttatggcatgcactgggtccgccaggctccaggcaaggggctggagtgggtggcagttatctcatatgatggaagtaatagatactatgcagactccgtgaagggccgattcaccatctccagagacaattccaagtacacgttggatctacacgtgagcagcctgacaactgatgacacggctgtttattactgtgcgcgagatcggagatatgggaagtgggaacaactctaccctgactacttgggccagggaaccctggtcaccgtctcctca

SEQ ID NO: 58 - protein, 123 aa, Artificial Sequence
  synthetic
QVQLVESGGGVVQPGRSLRLSCAASGFPFNSYGMHWVRQAPGKGLEWVAVISYDGSNRYYADSVKGRFTISRDNSKYTLDLHVSSLTTDDTAVYYCARDRRYGKWEQLYPDYLGQGTLVTVSS

SEQ ID NO: 59 - DNA, 24 bp, Artificial Sequence
  synthetic
ggattcccctttaatagttatggc

SEQ ID NO: 60 - protein, 8 aa, Artificial Sequence
  synthetic
GFPFNSYG

SEQ ID NO: 61 - DNA, 24 bp, Artificial Sequence
  synthetic
atctcatatgatggaagtaataga

SEQ ID NO: 62 - protein, 8 aa, Artificial Sequence
  synthetic
ISYDGSNR

SEQ ID NO: 63 - DNA, 48 bp, Artificial Sequence
  synthetic
gcgcgagatcggagatatgggaagtgggaacaactctaccctgactac

SEQ ID NO: 64 - protein, 16 aa, Artificial Sequence
  synthetic
ARDRRYGKWEQLYPDY

SEQ ID NO: 65 - DNA, 372 bp, Artificial Sequence
  synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagtcatttcatatgctggaaacaataaatactatgcagactccgtgaaaggccgattcaccgtttccagagacaattcgaagaaaacattgtatctgcaaatgaacagcctgagatctgaggacacggctgtgtattactgtgcgaaagattcgtattatgattttttgactgatcccgatgttttggatatctggggccaagggacaatggtcaccgtctcttca

SEQ ID NO: 66 - protein, 124 aa, Artificial Sequence
  synthetic
QVQLVESGGGVVQPGRSLRLSCAASGFTFSSYGMHWVRQAPGKGLEWVAVISYAGNNKYYADSVKGRFTVSRDNSKKTLYLQMNSLRSEDTAVYYCAKDSYYDFLTDPDVLDIWGQGTMVTVSS

SEQ ID NO: 67 - DNA, 24 bp, Artificial Sequence
  synthetic
ggattcaccttcagtagctatggc

SEQ ID NO: 68 - protein, 8 aa, Artificial Sequence
  synthetic
GFTFSSYG

SEQ ID NO: 69 - DNA, 24 bp, Artificial Sequence
  synthetic
atttcatatgctggaaacaataaa

SEQ ID NO: 70 - protein, 8 aa, Artificial Sequence
  synthetic
ISYAGNNK

SEQ ID NO: 71 - DNA, 51 bp, Artificial Sequence
  synthetic
gcgaaagattcgtattatgattttttgactgatcccgatgttttggatatc

SEQ ID NO: 72 - protein, 17 aa, Artificial Sequence
  synthetic
AKDSYYDFLTDPDVLDI

SEQ ID NO: 73 - DNA, 351 bp, Artificial Sequence
  synthetic
gaggtgcagctggtggagtctgggggaggcttggtccagtcgggggggtccctgagactctcctgtgaagcctctggattcacctttagtaactactggatgacctggatccgccagggtccagggaaggggctggaatgggtggccaacataaagccagatggaacggaaaattactatgtggactctgtgaagggccgattcaccatttccagagacaacgccaggaactcactgtatctacaaatgaccagcctgaaagccgaagacacggctgtgtattattgtgggagaatgatacaattcgtcattaatatttggggccagggaaccctggtcaccgtctcctca

SEQ ID NO: 74 - protein, 117 aa, Artificial Sequence
  synthetic
EVQLVESGGGLVQSGGSLRLSCEASGFTFSNYWMTWIRQGPGKGLEWVANIKPDGTENYYVDSVKGRFTISRDNARNSLYLQMTSLKAEDTAVYYCGRMIQFVINIWGQGTLVTVSS

SEQ ID NO: 75 - DNA, 24 bp, Artificial Sequence
  synthetic
ggattcacctttagtaactactgg

SEQ ID NO: 76 - protein, 8 aa, Artificial Sequence
  synthetic
GFTFSNYW

SEQ ID NO: 77 - DNA, 24 bp, Artificial Sequence
  synthetic
ataaagccagatggaacggaaaat

SEQ ID NO: 78 - protein, 8 aa, Artificial Sequence
  synthetic
IKPDGTEN

SEQ ID NO: 79 - DNA, 30 bp, Artificial Sequence
  synthetic
gggagaatgatacaattcgtcattaatatt

SEQ ID NO: 80 - protein, 10 aa, Artificial Sequence
  synthetic
GRMIQFVINI

SEQ ID NO: 81 - DNA, 372 bp, Artificial Sequence
  synthetic
caggtgcagctggtggagtctgggggaggcgtggtccagcctgggaggtccctgagactctcctgtgcagcctctggattcaccttcagaagctatggcatgcactgggtccgccaggctccaggcaaggggctggagtgggtggcatttatatcatatgatgaaagtaataaacaccaagcagactccgtgaagggccgattcaccatctccagagacaattccaagaacacgctgtatctgcaaatgaacagcctgagagctgaggacacggctgtgtatttctgtgcgaaagatcaatattacgattttttgactgcttatgatacccttgattactggggccagggaaccctggtcaccgtctcctca

SEQ ID NO: 82 - protein, 124 aa, Artificial Sequence
  synthetic
QVQLVESGGGVVQPGRSLRLSCAASGFTFRSYGMHWVRQAPGKGLEWVAFISYDESNKHQADSVKGRFTISRDNSKNTLYLQMNSLRAEDTAVYFCAKDQYYDFLTAYDTLDYWGQGTLVTVSS

SEQ ID NO: 83 - DNA, 24 bp, Artificial Sequence
  synthetic
ggattcaccttcagaagctatggc

SEQ ID NO: 84 - protein, 8 aa, Artificial Sequence
  synthetic
GFTFRSYG

SEQ ID NO: 85 - DNA, 24 bp, Artificial Sequence
  synthetic
atatcatatgatgaaagtaataaa

SEQ ID NO: 86 - protein, 8 aa, Artificial Sequence
  synthetic
ISYDESNK

SEQ ID NO: 87 - DNA, 51 bp, Artificial Sequence
  synthetic
gcgaaagatcaatattacgattttttgactgcttatgatacccttgattac

SEQ ID NO: 88 - protein, 17 aa, Artificial Sequence
  synthetic
AKDQYYDFLTAYDTLDY

SEQ ID NO: 89 - DNA, 372 bp, Artificial Sequence
  synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtgacatttatatcatatgatggaaataataaatactattcagactccgtgaagggccgattcgccatctccagagacaattccaagaacacactttatctgcaaatgaacagtctgagagctgaggacacgtctgtgtatttctgtgcgaaagatcagtattacgattttttgactgatttcggggtctttgactactggggccagggaaccctggtcaccgtctcctca

SEQ ID NO: 90 - protein, 124 aa, Artificial Sequence
  synthetic
QVQLVESGGGVVQPGRSLRLSCAASGFTFSSYGMHWVRQAPGKGLEWVTFISYDGNNKYYSDSVKGRFAISRDNSKNTLYLQMNSLRAEDTSVYFCAKDQYYDFLTDFGVFDYWGQGTLVTVSS

SEQ ID NO: 91 - DNA, 24 bp, Artificial Sequence
  synthetic
ggattcaccttcagtagctatggc

SEQ ID NO: 92 - protein, 8 aa, Artificial Sequence
  synthetic
GFTFSSYG

SEQ ID NO: 93 - DNA, 24 bp, Artificial Sequence
  synthetic
atatcatatgatggaaataataaa

SEQ ID NO: 94 - protein, 8 aa, Artificial Sequence
  synthetic
ISYDGNNK

SEQ ID NO: 95 - DNA, 51 bp, Artificial Sequence
  synthetic
gcgaaagatcagtattacgattttttgactgatttcggggtctttgactac

SEQ ID NO: 96 - protein, 17 aa, Artificial Sequence
  synthetic
AKDQYYDFLTDFGVFDY

SEQ ID NO: 97 - DNA, 372 bp, Artificial Sequence
  synthetic
caggtgcagctggtggagtctgggggaggcgtggtccagcctgggaggtccctgagactctcctgtgcagcctctggattcaccttcagtagttatggcatgcactgggtccgccaggctccaggcaaggggctggagtgggtggcatttatgtcatatgatggaagtaataaattctattcagactccgtgaagggccgattcaccatctccagagacaattccaggaaaatgctgtttctgcaaatgaacaacctgagagctgaggacacggctgtgtattactgtgcaagagatcagtattacgattttttgactgatcacggggtctttgactactggggccagggaaccctggtcaccgtctcctca

SEQ ID NO: 98 - protein, 124 aa, Artificial Sequence
  synthetic
QVQLVESGGGVVQPGRSLRLSCAASGFTFSSYGMHWVRQAPGKGLEWVAFMSYDGSNKFYSDSVKGRFTISRDNSRKMLFLQMNNLRAEDTAVYYCARDQYYDFLTDHGVFDYWGQGTLVTVSS

SEQ ID NO: 99 - DNA, 24 bp, Artificial Sequence
  synthetic
ggattcaccttcagtagttatggc

SEQ ID NO: 100 - protein, 8 aa, Artificial Sequence
  synthetic
GFTFSSYG

SEQ ID NO: 101 - DNA, 24 bp, Artificial Sequence
  synthetic
atgtcatatgatggaagtaataaa

SEQ ID NO: 102 - protein, 8 aa, Artificial Sequence
  synthetic
MSYDGSNK

SEQ ID NO: 103 - DNA, 51 bp, Artificial Sequence
  synthetic
gcaagagatcagtattacgattttttgactgatcacggggtctttgactac

SEQ ID NO: 104 - protein, 17 aa, Artificial Sequence
  synthetic
ARDQYYDFLTDHGVFDY

SEQ ID NO: 105 - DNA, 381 bp, Artificial Sequence
  synthetic
caggtgcagctggtggagtctgggggaggcgtggtccagcctgggaggtccctgagactctcctgtgcagcctctggattcaccttcattatctatgacatgcactgggtccgccaggctccaggcaaggggctggagtgggtggcagttatatcatatgatggaagtaataaatactatgcagactccgtgaagggccgattcaccatctccagagacaattccaagaacacgctgtatctgcagatgaacagcctgagagctgaggacacggctttttattactgtgcgaaagatcgtcagcgtggatatagtggctacgatgatgactattacggtatggacgtctggggccaagggaccacggtcaccgtctcctca

SEQ ID NO: 106 - protein, 127 aa, Artificial Sequence
  synthetic
QVQLVESGGGVVQPGRSLRLSCAASGFTFIIYDMHWVRQAPGKGLEWVAVISYDGSNKYYADSVKGRFTISRDNSKNTLYLQMNSLRAEDTAFYYCAKDRQRGYSGYDDDYYGMDVWGQGTTVTVSS

SEQ ID NO: 107 - DNA, 24 bp, Artificial Sequence
  synthetic
ggattcaccttcattatctatgac

SEQ ID NO: 108 - protein, 8 aa, Artificial Sequence
  synthetic
GFTFIIYD

SEQ ID NO: 109 - DNA, 24 bp, Artificial Sequence
  synthetic
atatcatatgatggaagtaataaa

SEQ ID NO: 110 - protein, 8 aa, Artificial Sequence
  synthetic
ISYDGSNK

SEQ ID NO: 111 - DNA, 60 bp, Artificial Sequence
  synthetic
gcgaaagatcgtcagcgtggatatagtggctacgatgatgactattacggtatggacgtc

SEQ ID NO: 112 - protein, 20 aa, Artificial Sequence
  synthetic
AKDRQRGYSGYDDDYYGMDV

SEQ ID NO: 113 - DNA, 369 bp, Artificial Sequence
  synthetic
caggtgcagctggtggagtctgggggaggcgtggtccagcctgggaggtccctgagactctcctgtgcagcgtctggattcaccttcagtagttatgacatccactgggtccgccaggctccaggcaaggggctggagtgggtgtcagttatatggtatgatggaagtaataagtactatgcagactccgtgaagggccgattcaccatctccagagacaattccaagaacacactgtatctgcaaatgaacagcctgagagccgaggacacggctgtgtattactgtgcgaggacggtagcagctcgaaactacgactactacgttatggacgtctggggccaagggaccacggtcaccgtctcctca

SEQ ID NO: 114 - protein, 123 aa, Artificial Sequence
  synthetic
QVQLVESGGGVVQPGRSLRLSCAASGFTFSSYDIHWVRQAPGKGLEWVSVIWYDGSNKYYADSVKGRFTISRDNSKNTLYLQMNSLRAEDTAVYYCARTVAARNYDYYVMDVWGQGTTVTVSS

SEQ ID NO: 115 - DNA, 24 bp, Artificial Sequence
  synthetic
ggattcaccttcagtagttatgac

SEQ ID NO: 116 - protein, 8 aa, Artificial Sequence
  synthetic
GFTFSSYD

SEQ ID NO: 117 - DNA, 24 bp, Artificial Sequence
  synthetic
atatggtatgatggaagtaataag

SEQ ID NO: 118 - protein, 8 aa, Artificial Sequence
  synthetic
IWYDGSNK

SEQ ID NO: 119 - DNA, 48 bp, Artificial Sequence
  synthetic
gcgaggacggtagcagctcgaaactacgactactacgttatggacgtc

SEQ ID NO: 120 - protein, 16 aa, Artificial Sequence
  synthetic
ARTVAARNYDYYVMDV

SEQ ID NO: 121 - DNA, 381 bp, Artificial Sequence
  synthetic
caggtgcagctggtggagtctgggggaggcgtggtccagcctgggaggtccctgagactctcctgtgcagcgtctggattcaccttcattacctatggcatgcactgggtccgccaggctccaggcaaggggctggagtgggtggcgattatttactatgatgaaagcaataaatactatgcagactccgtgaagggccgattcaccatctccagagacatttccaagaacacgctttatctgcaaatgaacggcctgagagccgaggacacggctgtatattactgtgcgagagccccccgtgtggcagtcgaggaagattattcctactattacggtatggacgtctggggccaagggaccacggtcaccgtctcctca

SEQ ID NO: 122 - protein, 127 aa, Artificial Sequence
  synthetic
QVQLVESGGGVVQPGRSLRLSCAASGFTFITYGMHWVRQAPGKGLEWVAIIYYDESNKYYADSVKGRFTISRDISKNTLYLQMNGLRAEDTAVYYCARAPRVAVEEDYSYYYGMDVWGQGTTVTVSS

SEQ ID NO: 123 - DNA, 24 bp, Artificial Sequence
  synthetic
ggattcaccttcattacctatggc

SEQ ID NO: 124 - protein, 8 aa, Artificial Sequence
  synthetic
GFTFITYG

SEQ ID NO: 125 - DNA, 24 bp, Artificial Sequence
  synthetic
atttactatgatgaaagcaataaa

SEQ ID NO: 126 - protein, 8 aa, Artificial Sequence
  synthetic
IYYDESNK

SEQ ID NO: 127 - DNA, 60 bp, Artificial Sequence
  synthetic
gcgagagccccccgtgtggcagtcgaggaagattattcctactattacggtatggacgtc

SEQ ID NO: 128 - protein, 20 aa, Artificial Sequence
  synthetic
ARAPRVAVEEDYSYYYGMDV

SEQ ID NO: 129 - DNA, 321 bp, Artificial Sequence
  synthetic
gacatccagatgacccagtctccatcctccctgtctgcatctgtaggagacagagtcaccatcacttgccgggcgagtcagggcattagaaatgatttaggctggtatcaacagaaaccagggagagcccctaagcgcctgatctatggtgcatccaatttgcaaagtggggtcccatcaaggttcagcggcagtggatctgggacagaattcactctcacaatcagcagcctgcagcctgaagattttgcaacttattactgtctacagcataatagtcacccgtacacttttggccaggggaccaagctggagatcaaa

SEQ ID NO: 130 - protein, 107 aa, Artificial Sequence
  synthetic
DIQMTQSPSSLSASVGDRVTITCRASQGIRNDLGWYQQKPGRAPKRLIYGASNLQSGVPSRFSGSGSGTEFTLTISSLQPEDFATYYCLQHNSHPYTFGQGTKLEIK

SEQ ID NO: 131 - DNA, 18 bp, Artificial Sequence
  synthetic
cagggcattagaaatgat

SEQ ID NO: 132 - protein, 6 aa, Artificial Sequence
  synthetic
QGIRND

SEQ ID NO: 133 - DNA, 9 bp, Artificial Sequence
  synthetic
ggtgcatcc

SEQ ID NO: 134 - protein, 3 aa, Artificial Sequence
  synthetic
GAS

SEQ ID NO: 135 - DNA, 27 bp, Artificial Sequence
  synthetic
ctacagcataatagtcacccgtacact

SEQ ID NO: 136 - protein, 9 aa, Artificial Sequence
  synthetic
LQHNSHPYT

SEQ ID NO: 137 - DNA, 351 bp, Artificial Sequence
  synthetic
gaggtgcaactggtggagtctgggggagccttggtccagactggggggtccctgcgactctcctgtgtagcctctggattcaccttcagcaactattggatgagctgggtccgccagtctccagggaaggggctgcagtgggtggcctccattaagaaagatggaagtgacgaagactatgtggactctgtgaagggccgattcaccatctccagggacaacgccgaaaattcactgtatctacagatgactagcctgagaatcgaggacacggctgtatattattgtgcgagatttatatcagcggttggagtagactggggccagggagccctggtcaccgtttcctca

SEQ ID NO: 138 - protein, 117 aa, Artificial Sequence
  synthetic
EVQLVESGGALVQTGGSLRLSCVASGFTFSNYWMSWVRQSPGKGLQWVASIKKDGSDEDYVDSVKGRFTISRDNAENSLYLQMTSLRIEDTAVYYCARFISAVGVDWGQGALVTVSS

SEQ ID NO: 139 - DNA, 24 bp, Artificial Sequence
  synthetic
ggattcaccttcagcaactattgg

SEQ ID NO: 140 - protein, 8 aa, Artificial Sequence
  synthetic
GFTFSNYW

SEQ ID NO: 141 - DNA, 24 bp, Artificial Sequence
  synthetic
attaagaaagatggaagtgacgaa

SEQ ID NO: 142 - protein, 8 aa, Artificial Sequence
  synthetic
IKKDGSDE

SEQ ID NO: 143 - DNA, 30 bp, Artificial Sequence
  synthetic
gcgagatttatatcagcggttggagtagac

SEQ ID NO: 144 - protein, 10 aa, Artificial Sequence
  synthetic
ARFISAVGVD

SEQ ID NO: 145 - DNA, 324 bp, Artificial Sequence
  synthetic
gacatccagatgacccagtctccatcctccctgtctgcatctgttggagacagcgtcaccatcacttgccgggcaagtcagagcattaacaactatttaaattggtatcagcagaaaccagggaaagcccctaagctcctgatctatactgcatccagtttgctaagtggggtcccttcaaggttcagtggcagtggatctgggacagatttcactctcaccatcagcggtctgcaccctgaagattttgcaacttacttctgtcaacagagtttcagtacccctccgatcaccttcggccaagggacacgactggacattaaa

SEQ ID NO: 146 - protein, 108 aa, Artificial Sequence
  synthetic
DIQMTQSPSSLSASVGDSVTITCRASQSINNYLNWYQQKPGKAPKLLIYTASSLLSGVPSRFSGSGSGTDFTLTISGLHPEDFATYFCQQSFSTPPITFGQGTRLDIK

SEQ ID NO: 147 - DNA, 18 bp, Artificial Sequence
  synthetic
cagagcattaacaactat

SEQ ID NO: 148 - protein, 6 aa, Artificial Sequence
  synthetic
QSINNY

SEQ ID NO: 149 - DNA, 9 bp, Artificial Sequence
  synthetic
actgcatcc

SEQ ID NO: 150 - protein, 3 aa, Artificial Sequence
  synthetic
TAS

SEQ ID NO: 151 - DNA, 30 bp, Artificial Sequence
  synthetic
caacagagtttcagtacccctccgatcacc

SEQ ID NO: 152 - protein, 10 aa, Artificial Sequence
  synthetic
QQSFSTPPIT

SEQ ID NO: 153 - DNA, 369 bp, Artificial Sequence
  synthetic
gaagtgcaactggtggagtctgggggaggcttagtacagcctggcgggtccctgagactctcctgtgcagccactggattcacctttgatgattttaccatgcactgggtccggcaagctccagggaagggcctggagtgggtctcaggtatcagttggaatagtggtagcataggctatgtggactctgtgaagggccgattcaccatctccagagacaacgccaagaactccctgtatctgcaaatgaacagtctgagagctgaggacacggccttgtactactgtgcaaaagataatagtggctacggctattattactacggtatggacgtctggggccaagggaccacggtcaccgtctcctca

SEQ ID NO: 154 - protein, 123 aa, Artificial Sequence
  synthetic
EVQLVESGGGLVQPGGSLRLSCAATGFTFDDFTMHWVRQAPGKGLEWVSGISWNSGSIGYVDSVKGRFTISRDNAKNSLYLQMNSLRAEDTALYYCAKDNSGYGYYYYGMDVWGQGTTVTVSS

SEQ ID NO: 155 - DNA, 24 bp, Artificial Sequence
  synthetic
ggattcacctttgatgattttacc

SEQ ID NO: 156 - protein, 8 aa, Artificial Sequence
  synthetic
GFTFDDFT

SEQ ID NO: 157 - DNA, 24 bp, Artificial Sequence
  synthetic
atcagttggaatagtggtagcata

SEQ ID NO: 158 - protein, 8 aa, Artificial Sequence
  synthetic
ISWNSGSI

SEQ ID NO: 159 - DNA, 48 bp, Artificial Sequence
  synthetic
gcaaaagataatagtggctacggctattattactacggtatggacgtc

SEQ ID NO: 160 - protein, 16 aa, Artificial Sequence
  synthetic
AKDNSGYGYYYYGMDV

SEQ ID NO: 161 - DNA, 321 bp, Artificial Sequence
  synthetic
gaaatagtgatgacgcagtctccagccaccctgtctgtgtctccaggggaaagagccaccctctcctgcagggccagtcacagtgttagcaggaactcagcctggtaccagcagaaacctggccaggctcccaggctcctcatctatggtgcatccaccagggccactggtatcccagccaggttcagtggcagtgggtctgggacagaattcactctcaccatcagcagcctgcagtctgaagattttgcaatttattactgtcagcagtataataattggcctctcactttcggcggagggaccaaggtggagatcaaa

SEQ ID NO: 162 - protein, 107 aa, Artificial Sequence
  synthetic
EIVMTQSPATLSVSPGERATLSCRASHSVSRNSAWYQQKPGQAPRLLIYGASTRATGIPARFSGSGSGTEFTLTISSLQSEDFAIYYCQQYNNWPLTFGGGTKVEIK

SEQ ID NO: 163 - DNA, 18 bp, Artificial Sequence
  synthetic
cacagtgttagcaggaac

SEQ ID NO: 164 - protein, 6 aa, Artificial Sequence
  synthetic
HSVSRN

SEQ ID NO: 165 - DNA, 9 bp, Artificial Sequence
  synthetic
ggtgcatcc

SEQ ID NO: 166 - protein, 3 aa, Artificial Sequence
  synthetic
GAS

SEQ ID NO: 167 - DNA, 27 bp, Artificial Sequence
  synthetic
cagcagtataataattggcctctcact

SEQ ID NO: 168 - protein, 9 aa, Artificial Sequence
  synthetic
QQYNNWPLT

SEQ ID NO: 169 - DNA, 372 bp, Artificial Sequence
  synthetic
gaagtgcaactggtggaatcggggggaggcttggtacagcctggcgggtccctgagactctcctgtgcagcctctggattctcctttgatgattataccatgcactgggtccggcaacctccagggaagggcctggagtgggtctcaggtattagttggaatagtggtagcataggctatgcggactctgtgaagggccgattcaccatctccagagacaacgccaagaactccctgtatctgcaaatgaacagtctgagagctggggacacggccttgtactactgtgcaaaagataatagtggctacggctattactactactacggtatggacgtctggggccaagggaccacggtcaccgtctcctca

SEQ ID NO: 170 - protein, 124 aa, Artificial Sequence
  synthetic
EVQLVESGGGLVQPGGSLRLSCAASGFSFDDYTMHWVRQPPGKGLEWVSGISWNSGSIGYADSVKGRFTISRDNAKNSLYLQMNSLRAGDTALYYCAKDNSGYGYYYYYGMDVWGQGTTVTVSS

SEQ ID NO: 171 - DNA, 24 bp, Artificial Sequence
  synthetic
ggattctcctttgatgattatacc

SEQ ID NO: 172 - protein, 8 aa, Artificial Sequence
  synthetic
GFSFDDYT

SEQ ID NO: 173 - DNA, 24 bp, Artificial Sequence
  synthetic
attagttggaatagtggtagcata

SEQ ID NO: 174 - protein, 8 aa, Artificial Sequence
  synthetic
ISWNSGSI

SEQ ID NO: 175 - DNA, 51 bp, Artificial Sequence
  synthetic
gcaaaagataatagtggctacggctattactactactacggtatggacgtc

SEQ ID NO: 176 - protein, 17 aa, Artificial Sequence
  synthetic
AKDNSGYGYYYYYGMDV

SEQ ID NO: 177 - DNA, 321 bp, Artificial Sequence
  synthetic
gaaatagtgatgacgcagtctccagccaccctgtctgtgtctccaggggaaagagccaccctctcctgcagggccagtcagagtgttagcagcaacttagcctggtaccagcagaaacctggccaggctcccagactcctcatctatggtgcatccaccagggccactggtatcccagccaggttcagtggcagtgggtctgggacagaattcactctcaccatcagcagcctgcagtctgaagattttgcagtttattactgtcagcagtattataactggcctctcactttcggcggagggaccaaggtggagatcaaa

SEQ ID NO: 178 - protein, 107 aa, Artificial Sequence
  synthetic
EIVMTQSPATLSVSPGERATLSCRASQSVSSNLAWYQQKPGQAPRLLIYGASTRATGIPARFSGSGSGTEFTLTISSLQSEDFAVYYCQQYYNWPLTFGGGTKVEIK

SEQ ID NO: 179 - DNA, 18 bp, Artificial Sequence
  synthetic
cagagtgttagcagcaac

SEQ ID NO: 180 - protein, 6 aa, Artificial Sequence
  synthetic
QSVSSN

SEQ ID NO: 181 - DNA, 9 bp, Artificial Sequence
  synthetic
ggtgcatcc

SEQ ID NO: 182 - protein, 3 aa, Artificial Sequence
  synthetic
GAS

SEQ ID NO: 183 - DNA, 27 bp, Artificial Sequence
  synthetic
cagcagtattataactggcctctcact

SEQ ID NO: 184 - protein, 9 aa, Artificial Sequence
  synthetic
QQYYNWPLT

SEQ ID NO: 185 - DNA, 372 bp, Artificial Sequence
  synthetic
gaagtacagctggtggagtctgggggaggcttggtacagcctggcaggtccctgagactctcctgtgtagcctctggattcccctttgctgattataccatgcactgggtccggcaagctccagggaagggcctggagtgggtctcagatattagttggaatagtggtagcaaaggctatgcggactctgtgaagggccgattcaccatctccagagacaatgccaagaactccctgtatctgcaaatgaacagtctgagaactgaggacacggccttctattactgtgcaaaagatatgagtggctacgcccactacttctactacggtatggacgtctggggccaagggaccacggtcaccgtctcctca

SEQ ID NO: 186 - protein, 124 aa, Artificial Sequence
  synthetic
EVQLVESGGGLVQPGRSLRLSCVASGFPFADYTMHWVRQAPGKGLEWVSDISWNSGSKGYADSVKGRFTISRDNAKNSLYLQMNSLRTEDTAFYYCAKDMSGYAHYFYYGMDVWGQGTTVTVSS

SEQ ID NO: 187 - DNA, 24 bp, Artificial Sequence
  synthetic
ggattcccctttgctgattatacc

SEQ ID NO: 188 - protein, 8 aa, Artificial Sequence
  synthetic
GFPFADYT

SEQ ID NO: 189 - DNA, 24 bp, Artificial Sequence
  synthetic
attagttggaatagtggtagcaaa

SEQ ID NO: 190 - protein, 8 aa, Artificial Sequence
  synthetic
ISWNSGSK

SEQ ID NO: 191 - DNA, 51 bp, Artificial Sequence
  synthetic
gcaaaagatatgagtggctacgcccactacttctactacggtatggacgtc

SEQ ID NO: 192 - protein, 17 aa, Artificial Sequence
  synthetic
AKDMSGYAHYFYYGMDV

SEQ ID NO: 193 - DNA, 324 bp, Artificial Sequence
  synthetic
gacatccagatgacccagtctccatcctccctgtctgcatctgtaggagacagagtcaccatcacttgccggccaagtcagagcattagcagctatttaaattggtttcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 194 - protein, 108 aa, Artificial Sequence
  synthetic
DIQMTQSPSSLSASVGDRVTITCRPSQSISSYLNWFQQKPGKAPKLLIYAASSLQSGVPSRFSGSGSGTDFTLTISSLQPEDFATYYCQQSYSTPPITFGQGTRLEIK

SEQ ID NO: 195 - DNA, 18 bp, Artificial Sequence
  synthetic
cagagcattagcagctat

SEQ ID NO: 196 - protein, 6 aa, Artificial Sequence
  synthetic
QSISSY

SEQ ID NO: 197 - DNA, 9 bp, Artificial Sequence
  synthetic
gctgcatcc

SEQ ID NO: 198 - protein, 3 aa, Artificial Sequence
  synthetic
AAS

SEQ ID NO: 199 - DNA, 30 bp, Artificial Sequence
  synthetic
caacagagttacagtacccctccgatcacc

SEQ ID NO: 200 - protein, 10 aa, Artificial Sequence
  synthetic
QQSYSTPPIT

SEQ ID NO: 201 - DNA, 372 bp, Artificial Sequence
  synthetic
gaagtacaactggtggagtctgggggaggcttggtacagcctggcaggtccctaagactctcctgtgcagcctctggattcacctttgatgattataccatgcactgggtccggcaagttccagggaagggcctggagtgggtctcaggtattagttggaatagtggcagcttggcctacgcggactctgtgaagggccgattcaccatctccagagacaacgccaagaattccctgtatctgcaaatgaacagtcttcaccctgaggacacggccctctattactgtgtaaaagatggtagtggctacggccactactcctactacggtttggacgtctggggccaggggaccacggtcaccgtctcctca

SEQ ID NO: 202 - protein, 124 aa, Artificial Sequence
  synthetic
EVQLVESGGGLVQPGRSLRLSCAASGFTFDDYTMHWVRQVPGKGLEWVSGISWNSGSLAYADSVKGRFTISRDNAKNSLYLQMNSLHPEDTALYYCVKDGSGYGHYSYYGLDVWGQGTTVTVSS

SEQ ID NO: 203 - DNA, 24 bp, Artificial Sequence
  synthetic
ggattcacctttgatgattatacc

SEQ ID NO: 204 - protein, 8 aa, Artificial Sequence
  synthetic
GFTFDDYT

SEQ ID NO: 205 - DNA, 24 bp, Artificial Sequence
  synthetic
attagttggaatagtggcagcttg

SEQ ID NO: 206 - protein, 8 aa, Artificial Sequence
  synthetic
ISWNSGSL

SEQ ID NO: 207 - DNA, 51 bp, Artificial Sequence
  synthetic
gtaaaagatggtagtggctacggccactactcctactacggtttggacgtc

SEQ ID NO: 208 - protein, 17 aa, Artificial Sequence
  synthetic
VKDGSGYGHYSYYGLDV

SEQ ID NO: 209 - DNA, 324 bp, Artificial Sequence
  synthetic
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagttcaccttggacgttcggccaagggaccaaggtggaaatcaaa

SEQ ID NO: 210 - protein, 108 aa, Artificial Sequence
  synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 211 - DNA, 21 bp, Artificial Sequence
  synthetic
cagagtgttagcagcagctac

SEQ ID NO: 212 - protein, 7 aa, Artificial Sequence
  synthetic
QSVSSSY

SEQ ID NO: 213 - DNA, 9 bp, Artificial Sequence
  synthetic
ggtgcatcc

SEQ ID NO: 214 - protein, 3 aa, Artificial Sequence
  synthetic
GAS

SEQ ID NO: 215 - DNA, 27 bp, Artificial Sequence
  synthetic
cagcagtatggtagttcaccttggacg

SEQ ID NO: 216 - protein, 9 aa, Artificial Sequence
  synthetic
QQYGSSPWT

SEQ ID NO: 217 - DNA, 372 bp, Artificial Sequence
  synthetic
gaagtacagctggtggagtctgggggaggcttggtacagcctggcaggtccctgagactctcctgtgtagcctctggattcccctttgctgattataccatgcactgggtccggcaagctccagggaagggcctggagtgggtctcagatattagttggaatagtggtagcataggctatgcggactctgtgaagggccgattcaccatctccagagacaatgccaagaactccctgtatctgcaaatgaacagtctgagaactgaggacacggccttgtattactgtgcaaaagatatgagtggctacgcccactacttctactacggtatggacgtctggggccaagggaccacggtcaccgtctcctca

SEQ ID NO: 218 - protein, 124 aa, Artificial Sequence
  synthetic
EVQLVESGGGLVQPGRSLRLSCVASGFPFADYTMHWVRQAPGKGLEWVSDISWNSGSIGYADSVKGRFTISRDNAKNSLYLQMNSLRTEDTALYYCAKDMSGYAHYFYYGMDVWGQGTTVTVSS

SEQ ID NO: 219 - DNA, 24 bp, Artificial Sequence
  synthetic
ggattcccctttgctgattatacc

SEQ ID NO: 220 - protein, 8 aa, Artificial Sequence
  synthetic
GFPFADYT

SEQ ID NO: 221 - DNA, 24 bp, Artificial Sequence
  synthetic
attagttggaatagtggtagcata

SEQ ID NO: 222 - protein, 8 aa, Artificial Sequence
  synthetic
ISWNSGSI

SEQ ID NO: 223 - DNA, 51 bp, Artificial Sequence; identical to SEQ ID NO: 191
  synthetic

SEQ ID NO: 224 - protein, 17 aa, Artificial Sequence
  synthetic
AKDMSGYAHYFYYGMDV

SEQ ID NO: 225 - DNA, 324 bp, Artificial Sequence
  synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccatcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 226 - protein, 108 aa, Artificial Sequence
  synthetic
DIQMTQSPSSLSASVGDRVTITCRASQSISSYLNWYQQKPGKAPKLLIFAASSLQSGVPSRFSGSGSGTDFTLTISSLQPEDFATYYCQQSYSTPPITFGQGTRLEIK

SEQ ID NO: 227 - DNA, 18 bp, Artificial Sequence
  synthetic
cagagcattagcagctat

SEQ ID NO: 228 - protein, 6 aa, Artificial Sequence
  synthetic
QSISSY

SEQ ID NO: 229 - DNA, 9 bp, Artificial Sequence
  synthetic
gctgcatcc

SEQ ID NO: 230 - protein, 3 aa, Artificial Sequence
  synthetic
AAS

SEQ ID NO: 231 - DNA, 30 bp, Artificial Sequence; identical to SEQ ID NO: 199
  synthetic

SEQ ID NO: 232 - protein, 10 aa, Artificial Sequence
  synthetic
QQSYSTPPIT

SEQ ID NO: 233 - DNA, 372 bp, Artificial Sequence
  synthetic
gaagtgcagctggtggagtctgggggaggcttggtacagcctggcaggtccctgaaactctcctgtacagcctctggattcacctttgctgattataccatgcactgggtccgacaaggtccagggaagggcctggagtgggtctcagatattagttggaatagtggtagtaaaggctatgcggactctgtgaagggccgattcaccatctccagagacaacgccaagaactccctgtatctgcaaatgaacagtctgagaactgaggacacggccttgtattactgtgcaaaagatatgagtggctacgcccactactactactacgctttggacgtctggggccaagggaccacggtcaccgtctcctca

SEQ ID NO: 234 - protein, 124 aa, Artificial Sequence
  synthetic
EVQLVESGGGLVQPGRSLKLSCTASGFTFADYTMHWVRQGPGKGLEWVSDISWNSGSKGYADSVKGRFTISRDNAKNSLYLQMNSLRTEDTALYYCAKDMSGYAHYYYYALDVWGQGTTVTVSS

SEQ ID NO: 235 - DNA, 24 bp, Artificial Sequence
  synthetic
ggattcacctttgctgattatacc

SEQ ID NO: 236 - protein, 8 aa, Artificial Sequence
  synthetic
GFTFADYT

SEQ ID NO: 237 - DNA, 24 bp, Artificial Sequence
  synthetic
attagttggaatagtggtagtaaa

SEQ ID NO: 238 - protein, 8 aa, Artificial Sequence
  synthetic
ISWNSGSK

SEQ ID NO: 239 - DNA, 51 bp, Artificial Sequence
  synthetic
gcaaaagatatgagtggctacgcccactactactactacgctttggacgtc

SEQ ID NO: 240 - protein, 17 aa, Artificial Sequence
  synthetic
AKDMSGYAHYYYYALDV

SEQ ID NO: 241 - DNA, 324 bp, Artificial Sequence
  synthetic
gacatccagatgacccagtctccatcctccctgtctgcatctgtaggagacagagtcaccatcacttgccgggcaagtcagagcattagcaactatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaaccccccgatcaccttcggccaagggacacgactggagattaaa

SEQ ID NO: 242 - protein, 108 aa, Artificial Sequence
  synthetic
DIQMTQSPSSLSASVGDRVTITCRASQSISNYLNWYQQKPGKAPKLLIYAASSLQSGVPSRFSGSGSGTDFTLTISSLQPEDFATYYCQQSYSNPPITFGQGTRLEIK

SEQ ID NO: 243 - DNA, 18 bp, Artificial Sequence
  synthetic
cagagcattagcaactat

SEQ ID NO: 244 - protein, 6 aa, Artificial Sequence
  synthetic
QSISNY

SEQ ID NO: 245 - DNA, 9 bp, Artificial Sequence
  synthetic
gctgcatcc

SEQ ID NO: 246 - protein, 3 aa, Artificial Sequence
  synthetic
AAS

SEQ ID NO: 247 - DNA, 30 bp, Artificial Sequence
  synthetic
caacagagttacagtaaccccccgatcacc

SEQ ID NO: 248 - protein, 10 aa, Artificial Sequence
  synthetic
QQSYSNPPIT

SEQ ID NO: 249 - DNA, 363 bp, Artificial Sequence
  synthetic
caggtgcagctggtggagtctgggggaggcgtggtccagcctgggaggtccctgagactctcctgtgcagcctctggattcaccttcagtagaaaaggcatgcactgggtccgccaggctccagtcaaggggctggagtgggtggcagttatatcatatgatggaagtaataaatactatgcagactccgtgaagggccgattcaccatctccagagacaattccaagaacacgctgtatctgcaaatgaacagcctgacagctgaggacacggctgtgtattactgtgcgaaagaaggggggcatgactatggtggtacctttgactactggggccagggaaccctggtcaccgtctcctca

SEQ ID NO: 250 - protein, 121 aa, Artificial Sequence
  synthetic
QVQLVESGGGVVQPGRSLRLSCAASGFTFSRKGMHWVRQAPVKGLEWVAVISYDGSNKYYADSVKGRFTISRDNSKNTLYLQMNSLTAEDTAVYYCAKEGGHDYGGTFDYWGQGTLVTVSS

SEQ ID NO: 251 - DNA, 24 bp, Artificial Sequence
  synthetic
ggattcaccttcagtagaaaaggc

SEQ ID NO: 252 - protein, 8 aa, Artificial Sequence
  synthetic
GFTFSRKG

SEQ ID NO: 253 - DNA, 24 bp, Artificial Sequence
  synthetic
atatcatatgatggaagtaataaa

SEQ ID NO: 254 - protein, 8 aa, Artificial Sequence
  synthetic
ISYDGSNK

SEQ ID NO: 255 - DNA, 42 bp, Artificial Sequence
  synthetic
gcgaaagaaggggggcatgactatggtggtacctttgactac

SEQ ID NO: 256 - protein, 14 aa, Artificial Sequence
  synthetic
AKEGGHDYGGTFDY

SEQ ID NO: 257 - DNA, 321 bp, Artificial Sequence
  synthetic
gacatccagatgacccagtctccatcctccctgtctgcatctgtaggagacagagtcaccatcacttgccaggcgagtcaggacattaacaactatttaaattggtatcagcagaaaccagggaaagcccctaagttcctgatctacgatgcatccaatttggaaacaggggtcccatcaaggttcagtggaagtggatctgggacagattttactttcaccatcagcagcctgcagcctgaagatattgcaacatattactgtcaacagtatgatgatctcccattcactttcggccctgggaccaaagtggatatcaaa

SEQ ID NO: 258 - protein, 107 aa, Artificial Sequence
  synthetic
DIQMTQSPSSLSASVGDRVTITCQASQDINNYLNWYQQKPGKAPKFLIYDASNLETGVPSRFSGSGSGTDFTFTISSLQPEDIATYYCQQYDDLPFTFGPGTKVDIK

SEQ ID NO: 259 - DNA, 18 bp, Artificial Sequence
  synthetic
caggacattaacaactat

SEQ ID NO: 260 - protein, 6 aa, Artificial Sequence
  synthetic
QDINNY

SEQ ID NO: 261 - DNA, 9 bp, Artificial Sequence
  synthetic
gatgcatcc

SEQ ID NO: 262 - protein, 3 aa, Artificial Sequence
  synthetic
DAS

SEQ ID NO: 263 - DNA, 27 bp, Artificial Sequence
  synthetic
caacagtatgatgatctcccattcact

SEQ ID NO: 264 - protein, 9 aa, Artificial Sequence
  synthetic
QQYDDLPFT

SEQ ID NO: 265 - DNA, 369 bp, Artificial Sequence
  synthetic
gaagtgcagctggtggagtctgggggaggcttggtacagcctggcaggtccctgagactctcctgtgcagcctctggattcacctttgatgattataccatgcactgggtccggcaagctccagggaagggcctggagtgggtctcaggtattagttggaatagtggtagtataggctatgcggactctgtgaagggccgattcaccatctccagagacaacgccaagaagtccctgtatctgcaaatgaacagtctgagagctgaggacacggccttgtattactgtgcaaaagataatagtggctacggtcactactactacggaatggacgtctggggccaagggaccacggtcaccgtcgcctca

SEQ ID NO: 266 - protein, 123 aa, Artificial Sequence
  synthetic
EVQLVESGGGLVQPGRSLRLSCAASGFTFDDYTMHWVRQAPGKGLEWVSGISWNSGSIGYADSVKGRFTISRDNAKKSLYLQMNSLRAEDTALYYCAKDNSGYGHYYYGMDVWGQGTTVTVAS

SEQ ID NO: 267 - DNA, 24 bp, Artificial Sequence
  synthetic
ggattcacctttgatgattatacc

SEQ ID NO: 268 - protein, 8 aa, Artificial Sequence
  synthetic
GFTFDDYT

SEQ ID NO: 269 - DNA, 24 bp, Artificial Sequence
  synthetic
attagttggaatagtggtagtata

SEQ ID NO: 270 - protein, 8 aa, Artificial Sequence
  synthetic
ISWNSGSI

SEQ ID NO: 271 - DNA, 48 bp, Artificial Sequence
  synthetic
gcaaaagataatagtggctacggtcactactactacggaatggacgtc

SEQ ID NO: 272 - protein, 16 aa, Artificial Sequence
  synthetic
AKDNSGYGHYYYGMDV

SEQ ID NO: 273 - DNA, 321 bp, Artificial Sequence
  synthetic
gaaatagtgatgacgcagtctccagccaccctgtctgtgtctccaggggaaagagccaccctctcctgcagggccagtcagagtgttagcagcaacttagcctggtaccagcaaaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcactatattaactggcctctcactttcggcggagggaccaaggtggagatcaaa

SEQ ID NO: 274 - protein, 107 aa, Artificial Sequence
  synthetic
EIVMTQSPATLSVSPGERATLSCRASQSVSSNLAWYQQKPGQAPRLLIYGASTRATGIPARFSGSGSGTEFTLTISSLQSEDFAVYYCQHYINWPLTFGGGTKVEIK

SEQ ID NO: 275 - DNA, 18 bp, Artificial Sequence
  synthetic
cagagtgttagcagcaac

SEQ ID NO: 276 - protein, 6 aa, Artificial Sequence
  synthetic
QSVSSN

SEQ ID NO: 277 - DNA, 9 bp, Artificial Sequence
  synthetic
ggtgcatcc

SEQ ID NO: 278 - protein, 3 aa, Artificial Sequence
  synthetic
GAS

SEQ ID NO: 279 - DNA, 27 bp, Artificial Sequence
  synthetic
cagcactatattaactggcctctcact

SEQ ID NO: 280 - protein, 9 aa, Artificial Sequence
  synthetic
QHYINWPLT

SEQ ID NO: 281 - DNA, 369 bp, Artificial Sequence; identical to SEQ ID NO: 265
  synthetic

SEQ ID NO: 282 - protein, 123 aa, Artificial Sequence; identical to SEQ ID NO: 266
  synthetic

SEQ ID NO: 283 - DNA, 24 bp, Artificial Sequence
  synthetic
ggattcacctttgatgattatacc

SEQ ID NO: 284 - protein, 8 aa, Artificial Sequence
  synthetic
GFTFDDYT

SEQ ID NO: 285 - DNA, 24 bp, Artificial Sequence
  synthetic
attagttggaatagtggtagtata

SEQ ID NO: 286 - protein, 8 aa, Artificial Sequence
  synthetic
ISWNSGSI

SEQ ID NO: 287 - DNA, 48 bp, Artificial Sequence; identical to SEQ ID NO: 271
  synthetic

SEQ ID NO: 288 - protein, 16 aa, Artificial Sequence
  synthetic
AKDNSGYGHYYYGMDV

SEQ ID NO: 289 - DNA, 321 bp, Artificial Sequence; identical to SEQ ID NO: 273
  synthetic

SEQ ID NO: 290 - protein, 107 aa, Artificial Sequence; identical to SEQ ID NO: 274
  synthetic

SEQ ID NO: 291 - DNA, 18 bp, Artificial Sequence
  synthetic
cagagtgttagcagcaac

SEQ ID NO: 292 - protein, 6 aa, Artificial Sequence
  synthetic
QSVSSN

SEQ ID NO: 293 - DNA, 9 bp, Artificial Sequence
  synthetic
ggtgcatcc

SEQ ID NO: 294 - protein, 3 aa, Artificial Sequence
  synthetic
GAS

SEQ ID NO: 295 - DNA, 27 bp, Artificial Sequence
  synthetic
cagcactatattaactggcctctcact

SEQ ID NO: 296 - protein, 9 aa, Artificial Sequence
  synthetic
QHYINWPLT

SEQ ID NO: 297 - DNA, 354 bp, Artificial Sequence
  synthetic
caggtgcagttggtggagtctgggggaggcgtggtccagcctgggaggtccctgagactctcctgtggtgcgtctggattcaccttcagaagttatggcatgcactgggtccgccagactccaggcagggggctggagtgggtggcaatgatatattatgatggaaataataaatactatgcagactccgtgaggggccgattcaccgtttccagagacaattccaagaacaccctgtatctgcaaatgagcagcctgagagccgaggacacggctctatatttctgtgcgcgagggcctgggtacaactggctcgacccctggggccagggaaccctggtcaccgtctcctca

SEQ ID NO: 298 - protein, 118 aa, Artificial Sequence
  synthetic
QVQLVESGGGVVQPGRSLRLSCGASGFTFRSYGMHWVRQTPGRGLEWVAMIYYDGNNKYYADSVRGRFTVSRDNSKNTLYLQMSSLRAEDTALYFCARGPGYNWLDPWGQGTLVTVSS

SEQ ID NO: 299 - DNA, 24 bp, Artificial Sequence
  synthetic
ggattcaccttcagaagttatggc

SEQ ID NO: 300 - protein, 8 aa, Artificial Sequence
  synthetic
GFTFRSYG

SEQ ID NO: 301 - DNA, 24 bp, Artificial Sequence
  synthetic
atatattatgatggaaataataaa

SEQ ID NO: 302 - protein, 8 aa, Artificial Sequence
  synthetic
IYYDGNNK

SEQ ID NO: 303 - DNA, 33 bp, Artificial Sequence
  synthetic
gcgcgagggcctgggtacaactggctcgacccc

SEQ ID NO: 304 - protein, 11 aa, Artificial Sequence
  synthetic
ARGPGYNWLDP

SEQ ID NO: 305 - DNA, 321 bp, Artificial Sequence
  synthetic
gaaatagtgatgacgcagtctccagccaccctgtctgtgtctccaggggaaagagccaccctctcctgcagggccagtcagagtattagcaggaacttggcctggtaccagcaraaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataaccggcctctcactttcggcggagggaccgaggtggagatcaaa

SEQ ID NO: 306 - protein, 107 aa, Artificial Sequence
  synthetic
  VARIANT 38: Xaa = Any Amino Acid
EIVMTQSPATLSVSPGERATLSCRASQSISRNLAWYQXKPGQAPRLLIYGASTRATGIPARFSGSGSGTEFTLTISSLQSEDFAVYYCQQYNNRPLTFGGGTEVEIK

SEQ ID NO: 307 - DNA, 18 bp, Artificial Sequence
  synthetic
cagagtattagcaggaac

SEQ ID NO: 308 - protein, 6 aa, Artificial Sequence
  synthetic
QSISRN

SEQ ID NO: 309 - DNA, 9 bp, Artificial Sequence
  synthetic
ggtgcatcc

SEQ ID NO: 310 - protein, 3 aa, Artificial Sequence
  synthetic
GAS

SEQ ID NO: 311 - DNA, 27 bp, Artificial Sequence
  synthetic
cagcagtataataaccggcctctcact

SEQ ID NO: 312 - protein, 9 aa, Artificial Sequence
  synthetic
QQYNNRPLT

SEQ ID NO: 313 - DNA, 354 bp, Artificial Sequence
  synthetic
caggtgcagttggtggagtctgggggaggcgtggtccagcctgggaggtccctgagactcgcctgtgttgcgtctggattcaccttcagaagttatggcatgcactgggtccgccaggctccaggcaagggactgcagtgggtggcaatgatttactatgatggtaagaataaatattatgcagactccgtgaggggccgattcaccatctccagagacaattccaagaacacactgtatctgcaaatgaacaatctgagagtcgaggacacggctatgtatttctgtgcgcgagggcctgggtacaattggctcgacccctggggccagggaaccctggtcactgtttcctca

SEQ ID NO: 314 - protein, 118 aa, Artificial Sequence
  synthetic
QVQLVESGGGVVQPGRSLRLACVASGFTFRSYGMHWVRQAPGKGLQWVAMIYYDGKNKYYADSVRGRFTISRDNSKNTLYLQMNNLRVEDTAMYFCARGPGYNWLDPWGQGTLVTVSS

SEQ ID NO: 315 - DNA, 24 bp, Artificial Sequence
  synthetic
ggattcaccttcagaagttatggc

SEQ ID NO: 316 - protein, 8 aa, Artificial Sequence
  synthetic
GFTFRSYG

SEQ ID NO: 317 - DNA, 24 bp, Artificial Sequence
  synthetic
atttactatgatggtaagaataaa

SEQ ID NO: 318 - protein, 8 aa, Artificial Sequence
  synthetic
IYYDGKNK

SEQ ID NO: 319 - DNA, 33 bp, Artificial Sequence
  synthetic
gcgcgagggcctgggtacaattggctcgacccc

SEQ ID NO: 320 - protein, 11 aa, Artificial Sequence
  synthetic
ARGPGYNWLDP

SEQ ID NO: 321 - DNA, 321 bp, Artificial Sequence
  synthetic
gaaatagtgatgacgcagtctccagccaccctgtctgtgtctccaggggaaagagccaccctctcctgcagggccagtcagagaattagcagcaacttggcctggtaccagcaaaaacctggccaggctcccaggctcctcatctatggtgcatccaccagggccactggtagcccagccaggttcagtggcagtgggtctgggacagacttcactctcaccatcagcagcctgcagtctgaggatgttgcagtttattactgtcagcaacatcataactggcctctcactttcggcggagggaccaaggtggagatcaaa

SEQ ID NO: 322 - protein, 107 aa, Artificial Sequence
  synthetic
EIVMTQSPATLSVSPGERATLSCRASQRISSNLAWYQQKPGQAPRLLIYGASTRATGSPARFSGSGSGTDFTLTISSLQSEDVAVYYCQQHHNWPLTFGGGTKVEIK

SEQ ID NO: 323 - DNA, 18 bp, Artificial Sequence
  synthetic
cagagaattagcagcaac

SEQ ID NO: 324 - protein, 6 aa, Artificial Sequence
  synthetic
QRISSN

SEQ ID NO: 325 - DNA, 9 bp, Artificial Sequence
  synthetic
ggtgcatcc

SEQ ID NO: 326 - protein, 3 aa, Artificial Sequence
  synthetic
GAS

SEQ ID NO: 327 - DNA, 27 bp, Artificial Sequence
  synthetic
cagcaacatcataactggcctctcact

SEQ ID NO: 328 - protein, 9 aa, Artificial Sequence
  synthetic
QQHHNWPLT

SEQ ID NO: 329 - DNA, 354 bp, Artificial Sequence
  synthetic
caggtgcagctggtggagtctgggggaggcgtggtccagcctgggaggtccctgagactctcctgtgctgcgtctggatttaccttcagaagttatgccatgcactgggtccgccaggctccaggcaaggggctggagtgggtggcaatggtatactatgatggaaataatcaatactatgcagactccgtgaggggccgattcaccatctccagagacaattccaagaacacgctgtatctgcaaatgaacagcctgagagccgatgacacggctgtgtatttctgtgcgcgagggcctgggtacaactggctcgacccctggggccagggaaccctggtcaccgtctcctca

SEQ ID NO: 330 - protein, 118 aa, Artificial Sequence
  synthetic
QVQLVESGGGVVQPGRSLRLSCAASGFTFRSYAMHWVRQAPGKGLEWVAMVYYDGNNQYYADSVRGRFTISRDNSKNTLYLQMNSLRADDTAVYFCARGPGYNWLDPWGQGTLVTVSS

SEQ ID NO: 331 - DNA, 24 bp, Artificial Sequence
  synthetic
ggatttaccttcagaagttatgcc

SEQ ID NO: 332 - protein, 8 aa, Artificial Sequence
  synthetic
GFTFRSYA

SEQ ID NO: 333 - DNA, 24 bp, Artificial Sequence
  synthetic
gtatactatgatggaaataatcaa

SEQ ID NO: 334 - protein, 8 aa, Artificial Sequence
  synthetic
VYYDGNNQ

SEQ ID NO: 335 - DNA, 33 bp, Artificial Sequence; identical to SEQ ID NO: 303
  synthetic

SEQ ID NO: 336 - protein, 11 aa, Artificial Sequence
  synthetic
ARGPGYNWLDP

SEQ ID NO: 337 - DNA, 321 bp, Artificial Sequence
  synthetic
gaaatagtgatgacgcagtctccagccaccctgtctgtgtctccaggggaaagagccaccctctcctgcagggccagtcagagtgttagcaggaacttggcctggtaccagcaaaaacctggccaggctcccaggctcctcatctatggtgcatccaccagggccactggtatcccggccaggttcagtggcagtgggtctgggacagacttcactctcaccatcagcagcctgcagtctgaagattttgcagtttattactgtcagcagtataataactggcctctcactttcggcggagggaccaaggtggtgatcaaa

SEQ ID NO: 338 - protein, 107 aa, Artificial Sequence
  synthetic
EIVMTQSPATLSVSPGERATLSCRASQSVSRNLAWYQQKPGQAPRLLIYGASTRATGIPARFSGSGSGTDFTLTISSLQSEDFAVYYCQQYNNWPLTFGGGTKVVIK

SEQ ID NO: 339 - DNA, 18 bp, Artificial Sequence
  synthetic
cagagtgttagcaggaac

SEQ ID NO: 340 - protein, 6 aa, Artificial Sequence
  synthetic
QSVSRN

SEQ ID NO: 341 - DNA, 9 bp, Artificial Sequence
  synthetic
ggtgcatcc

SEQ ID NO: 342 - protein, 3 aa, Artificial Sequence
  synthetic
GAS

SEQ ID NO: 343 - DNA, 27 bp, Artificial Sequence
  synthetic
cagcagtataataactggcctctcact

SEQ ID NO: 344 - protein, 9 aa, Artificial Sequence
  synthetic
QQYNNWPLT

SEQ ID NO: 345 - DNA, 354 bp, Artificial Sequence
  synthetic
caggtgcagctggtggagtctgggggaggcgtggtccagcctgggaggtccctgagactctcctgtattgcgtctggatttaccttcagaagttatggcatgcactgggtccgccaggctccaggcaaggggctggagtgggtggcaatgatatattatgatggaaacaataaatactatgcagactccgtgaggggccgattcaccatctccagagacaactccaagaacacgctgtatctgcaaatgaacagcctgagagccgatgacacggctgtgtatttctgtgcgcgagggcctgggtacaactggctcgacccctggggccagggaaccctggtcaccgtctcctca

SEQ ID NO: 346 - protein, 118 aa, Artificial Sequence
  synthetic
QVQLVESGGGVVQPGRSLRLSCIASGFTFRSYGMHWVRQAPGKGLEWVAMIYYDGNNKYYADSVRGRFTISRDNSKNTLYLQMNSLRADDTAVYFCARGPGYNWLDPWGQGTLVTVSS

SEQ ID NO: 347 - DNA, 24 bp, Artificial Sequence
  synthetic
ggatttaccttcagaagttatggc

SEQ ID NO: 348 - protein, 8 aa, Artificial Sequence
  synthetic
GFTFRSYG

SEQ ID NO: 349 - DNA, 24 bp, Artificial Sequence
  synthetic
atatattatgatggaaacaataaa

SEQ ID NO: 350 - protein, 8 aa, Artificial Sequence
  synthetic
IYYDGNNK

SEQ ID NO: 351 - DNA, 33 bp, Artificial Sequence; identical to SEQ ID NO: 303
  synthetic

SEQ ID NO: 352 - protein, 11 aa, Artificial Sequence
  synthetic
ARGPGYNWLDP

SEQ ID NO: 353 - DNA, 321 bp, Artificial Sequence
  synthetic
gaaatagtgatgacgcagtctccagccacactgtctgtgtctccaggggaaagagccaccctctcctgcagggccagtcagagtgttagcagcaacttggcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataacaggcctctcactttcggcggagggaccaaggtggagatcaaa

SEQ ID NO: 354 - protein, 107 aa, Artificial Sequence
  synthetic
EIVMTQSPATLSVSPGERATLSCRASQSVSSNLAWYQQKPGQAPRLLIYGASTRATGIPARFSGSGSGTEFTLTISSLQSEDFAVYYCQQYNNRPLTFGGGTKVEIK

SEQ ID NO: 355 - DNA, 18 bp, Artificial Sequence
  synthetic
cagagtgttagcagcaac

SEQ ID NO: 356 - protein, 6 aa, Artificial Sequence
  synthetic
QSVSSN

SEQ ID NO: 357 - DNA, 9 bp, Artificial Sequence
  synthetic
ggtgcatcc

SEQ ID NO: 358 - protein, 3 aa, Artificial Sequence
  synthetic
GAS

SEQ ID NO: 359 - DNA, 27 bp, Artificial Sequence
  synthetic
cagcagtataataacaggcctctcact

SEQ ID NO: 360 - protein, 9 aa, Artificial Sequence
  synthetic
QQYNNRPLT

SEQ ID NO: 361 - DNA, 354 bp, Artificial Sequence
  synthetic
caggtgcagctggtggagtctgggggaggcgtggtccagccggggaggtccctgagactctcctgtgctgcgtctggattcaccttcagaagttttggcatgcactgggtccgccaggctccaggcaggggactggagtgggtggcaatgatatattttgatggaaaaaataaatactatgcagactccgtgaggggccgattcaccatttccagagacaattccaagaacaccctgtatctggaaatgagtagcctgagagccgaggacacggctgtatatttctgtgcgcgagggcctgggtacaactggctcgacccctggggccagggaaccctggtcaccgtctcctca

SEQ ID NO: 362 - protein, 118 aa, Artificial Sequence
  synthetic
QVQLVESGGGVVQPGRSLRLSCAASGFTFRSFGMHWVRQAPGRGLEWVAMIYFDGKNKYYADSVRGRFTISRDNSKNTLYLEMSSLRAEDTAVYFCARGPGYNWLDPWGQGTLVTVSS

SEQ ID NO: 363 - DNA, 24 bp, Artificial Sequence
  synthetic
ggattcaccttcagaagttttggc

SEQ ID NO: 364 - protein, 8 aa, Artificial Sequence
  synthetic
GFTFRSFG

SEQ ID NO: 365 - DNA, 24 bp, Artificial Sequence
  synthetic
atatattttgatggaaaaaataaa

SEQ ID NO: 366 - protein, 8 aa, Artificial Sequence
  synthetic
IYFDGKNK

SEQ ID NO: 367 - DNA, 33 bp, Artificial Sequence; identical to SEQ ID NO: 303
  synthetic

SEQ ID NO: 368 - protein, 11 aa, Artificial Sequence
  synthetic
ARGPGYNWLDP

SEQ ID NO: 369 - DNA, 321 bp, Artificial Sequence
  synthetic
gaaatagtgatgacgcagtctccagccaccctgtctgtgtctccaggggaaagagtcaccctctcctgtagggccagtcagagtattagcaggaacttggcctggtaccagcagaaacctggccaggctcccaggctcctcatctatggtgcatccaccagggccactggtgtcccagccaggttcagtggcagtgggtctgggacagagttcactctcaccatcagcagcctacagtctgaagattttgcagtttttcactgtcagcagtataataataggcctctcactttcggcggagggaccgaggtggagatcaaa

SEQ ID NO: 370 - protein, 107 aa, Artificial Sequence
  synthetic
EIVMTQSPATLSVSPGERVTLSCRASQSISRNLAWYQQKPGQAPRLLIYGASTRATGVPARFSGSGSGTEFTLTISSLQSEDFAVFHCQQYNNRPLTFGGGTEVEIK

SEQ ID NO: 371 - DNA, 18 bp, Artificial Sequence
  synthetic
cagagtattagcaggaac

SEQ ID NO: 372 - protein, 6 aa, Artificial Sequence
  synthetic
QSISRN

SEQ ID NO: 373 - DNA, 9 bp, Artificial Sequence
  synthetic
ggtgcatcc

SEQ ID NO: 374 - protein, 3 aa, Artificial Sequence
  synthetic
GAS

SEQ ID NO: 375 - DNA, 27 bp, Artificial Sequence
  synthetic
cagcagtataataataggcctctcact

SEQ ID NO: 376 - protein, 9 aa, Artificial Sequence
  synthetic
QQYNNRPLT

SEQ ID NO: 377 - DNA, 354 bp, Artificial Sequence
  synthetic
caggtgcaattggtggagtctgggggaggcgtggtccagccggggaggtccctgagactctcctgtgctgcgtctggattcaccttcagaagttttggcatgcactgggtccgccaggctccaggcaggggactggagtgggtggcaatgatatattttgatggaaaaaataaatactatgcagactccgtgaggggccgattcaccatttccagagacaattccaagaacaccctgtatctggaaatgagtagcctgagagccgaggacacggctgtatatttctgtgcgcgagggcctgggtacaactggctcgacccctggggccagggaaccctggtcaccgtctcctca

SEQ ID NO: 378 - protein, 118 aa, Artificial Sequence; identical to SEQ ID NO: 362
  synthetic

SEQ ID NO: 379 - DNA, 24 bp, Artificial Sequence
  synthetic
ggattcaccttcagaagttttggc

SEQ ID NO: 380 - protein, 8 aa, Artificial Sequence
  synthetic
GFTFRSFG

SEQ ID NO: 381 - DNA, 24 bp, Artificial Sequence
  synthetic
atatattttgatggaaaaaataaa

SEQ ID NO: 382 - protein, 8 aa, Artificial Sequence
  synthetic
IYFDGKNK

SEQ ID NO: 383 - DNA, 33 bp, Artificial Sequence; identical to SEQ ID NO: 303
  synthetic

SEQ ID NO: 384 - protein, 11 aa, Artificial Sequence
  synthetic
ARGPGYNWLDP

SEQ ID NO: 385 - DNA, 321 bp, Artificial Sequence
  synthetic
gaaatagtgatgacgcagtctccagccaccctgtctgtgtctccaggggaaagagtcaccctctcctgtagggccagtcagagtattagcaggaacttggcctggtaccagcaraaacctggccaggctcccaggctcctcatctatggtgcatccaccagggccactggtgtcccagccaggttcagtggcagtgggtctgggacagagttcactctcaccatcagcagcctacagtctgaagattttgcagtttttcactgtcagcagtataataataggcctctcactttcggcggagggaccgaggtggagatcaaa

SEQ ID NO: 386 - protein, 107 aa, Artificial Sequence
  synthetic
  VARIANT 38: Xaa = Any Amino Acid
EIVMTQSPATLSVSPGERVTLSCRASQSISRNLAWYQXKPGQAPRLLIYGASTRATGVPARFSGSGSGTEFTLTISSLQSEDFAVFHCQQYNNRPLTFGGGTEVEIK

SEQ ID NO: 387 - DNA, 18 bp, Artificial Sequence
  synthetic
cagagtattagcaggaac

SEQ ID NO: 388 - protein, 6 aa, Artificial Sequence
  synthetic
QSISRN

SEQ ID NO: 389 - DNA, 9 bp, Artificial Sequence
  synthetic
ggtgcatcc

SEQ ID NO: 390 - protein, 3 aa, Artificial Sequence
  synthetic
GAS

SEQ ID NO: 391 - DNA, 27 bp, Artificial Sequence
  synthetic
cagcagtataataataggcctctcact

SEQ ID NO: 392 - protein, 9 aa, Artificial Sequence
  synthetic
QQYNNRPLT

SEQ ID NO: 393 - DNA, 354 bp, Artificial Sequence
  synthetic
caggtgcaattggtggagtctgggggaggcgtggtccagccggggaggtccctgagactctcctgtgctgcgtctggattcaccttcagaagttttggcatgcactgggtccgccaggctccaggcaggggactggagtgggtggcaatgatatattttgatggaaaaaataaatactatgcagactccgtgaggggccgattcaccatttccagagacaattccaagaacaccctgtatctggaaatgagcagcctgagagccgaggacacggctgtatatttctgtgcgcgagggcctgggtacaattggctcgacccctggggccagggaaccctggtcaccgtctcctca

SEQ ID NO: 394 - protein, 118 aa, Artificial Sequence; identical to SEQ ID NO: 362
  synthetic

SEQ ID NO: 395 - DNA, 24 bp, Artificial Sequence
  synthetic
ggattcaccttcagaagttttggc

SEQ ID NO: 396 - protein, 8 aa, Artificial Sequence
  synthetic
GFTFRSFG

SEQ ID NO: 397 - DNA, 24 bp, Artificial Sequence
  synthetic
atatattttgatggaaaaaataaa

SEQ ID NO: 398 - protein, 8 aa, Artificial Sequence
  synthetic
IYFDGKNK

SEQ ID NO: 399 - DNA, 33 bp, Artificial Sequence; identical to SEQ ID NO: 319
  synthetic

SEQ ID NO: 400 - protein, 11 aa, Artificial Sequence
  synthetic
ARGPGYNWLDP

SEQ ID NO: 401 - DNA, 321 bp, Artificial Sequence
  synthetic
gaaatagtgatgacgcagtctccagccaccctgtctgtgtctccaggggaaagagccaccctctcctgtagggccagtcagagtgttagcaggaacttggcctggtaccagcaaaaacctggccaggctcccaggctcctcatctatggtgcatccaccagggccactggtgtcccagccaggttcagtggcagtgggtctgggacagagttcactctcaccatcagcagcctacagtctgaagattttgcagtttttcactgtcagcagtataataataggcctctcactttcggcggagggaccgaggtggagatcaaa

SEQ ID NO: 402 - protein, 107 aa, Artificial Sequence
  synthetic
EIVMTQSPATLSVSPGERATLSCRASQSVSRNLAWYQQKPGQAPRLLIYGASTRATGVPARFSGSGSGTEFTLTISSLQSEDFAVFHCQQYNNRPLTFGGGTEVEIK

SEQ ID NO: 403 - DNA, 18 bp, Artificial Sequence
  synthetic
cagagtgttagcaggaac

SEQ ID NO: 404 - protein, 6 aa, Artificial Sequence
  synthetic
QSVSRN

SEQ ID NO: 405 - DNA, 9 bp, Artificial Sequence
  synthetic
ggtgcatcc

SEQ ID NO: 406 - protein, 3 aa, Artificial Sequence
  synthetic
GAS

SEQ ID NO: 407 - DNA, 27 bp, Artificial Sequence
  synthetic
cagcagtataataataggcctctcact

SEQ ID NO: 408 - protein, 9 aa, Artificial Sequence
  synthetic
QQYNNRPLT

SEQ ID NO: 409 - DNA, 354 bp, Artificial Sequence; identical to SEQ ID NO: 393
  synthetic

SEQ ID NO: 410 - protein, 118 aa, Artificial Sequence; identical to SEQ ID NO: 362
  synthetic

SEQ ID NO: 411 - DNA, 24 bp, Artificial Sequence
  synthetic
ggattcaccttcagaagttttggc

SEQ ID NO: 412 - protein, 8 aa, Artificial Sequence
  synthetic
GFTFRSFG

SEQ ID NO: 413 - DNA, 24 bp, Artificial Sequence
  synthetic
atatattttgatggaaaaaataaa

SEQ ID NO: 414 - protein, 8 aa, Artificial Sequence
  synthetic
IYFDGKNK

SEQ ID NO: 415 - DNA, 33 bp, Artificial Sequence; identical to SEQ ID NO: 319
  synthetic

SEQ ID NO: 416 - protein, 11 aa, Artificial Sequence
  synthetic
ARGPGYNWLDP

SEQ ID NO: 417 - DNA, 321 bp, Artificial Sequence; identical to SEQ ID NO: 401
  synthetic

SEQ ID NO: 418 - protein, 107 aa, Artificial Sequence; identical to SEQ ID NO: 402
  synthetic

SEQ ID NO: 419 - DNA, 18 bp, Artificial Sequence
  synthetic
cagagtgttagcaggaac

SEQ ID NO: 420 - protein, 6 aa, Artificial Sequence
  synthetic
QSVSRN

SEQ ID NO: 421 - DNA, 9 bp, Artificial Sequence
  synthetic
ggtgcatcc

SEQ ID NO: 422 - protein, 3 aa, Artificial Sequence
  synthetic
GAS

SEQ ID NO: 423 - DNA, 27 bp, Artificial Sequence
  synthetic
cagcagtataataataggcctctcact

SEQ ID NO: 424 - protein, 9 aa, Artificial Sequence
  synthetic
QQYNNRPLT

SEQ ID NO: 425 - DNA, 354 bp, Artificial Sequence
  synthetic
caggtgcagttggtggagtctgggggaggcgtggtccagcctgggaggtccctgagactctcctgtgttgcgtctggattcaccttcagaagttatggcatgcactgggtccgccaggctccaggcaagggactgcagtgggtggcaatgatttactatgatggtaagaataaatattatgcagactccgtgaggggccgattcaccatctccagagacaattccaagaacacgctgtatctgcaaatgaacagtctgagagccgaagacacggctatgtatttctgtgcgcgagggcctgggtacaactggctcgacccctggggccagggaaccctggtcactgtctcctca

SEQ ID NO: 426 - protein, 118 aa, Artificial Sequence
  synthetic
QVQLVESGGGVVQPGRSLRLSCVASGFTFRSYGMHWVRQAPGKGLQWVAMIYYDGKNKYYADSVRGRFTISRDNSKNTLYLQMNSLRAEDTAMYFCARGPGYNWLDPWGQGTLVTVSS

SEQ ID NO: 427 - DNA, 24 bp, Artificial Sequence
  synthetic
ggattcaccttcagaagttatggc

SEQ ID NO: 428 - protein, 8 aa, Artificial Sequence
  synthetic
GFTFRSYG

SEQ ID NO: 429 - DNA, 24 bp, Artificial Sequence
  synthetic
atttactatgatggtaagaataaa

SEQ ID NO: 430 - protein, 8 aa, Artificial Sequence
  synthetic
IYYDGKNK

SEQ ID NO: 431 - DNA, 33 bp, Artificial Sequence; identical to SEQ ID NO: 303
  synthetic

SEQ ID NO: 432 - protein, 11 aa, Artificial Sequence
  synthetic
ARGPGYNWLDP

SEQ ID NO: 433 - DNA, 321 bp, Artificial Sequence
  synthetic
gaaatagtgatgacgcagtctccagccaccctgtctgtgtctccaggggaaagagccaccctctcctgcagggccagtcagagaattagcagcaacttggcctggtaccagcaaaaacctggccaggctcccaggctcctcatctatggtgcatccaccagggccactggtagcccagccaggttcagtggcagtgggtctgggacagagttcactctcaccatcagcagcctgcagtctgaagatgttgcagtttattactgtcagcaacataataactggcctctcactttcggcggagggaccaaggtggagatcaaa

SEQ ID NO: 434 - protein, 107 aa, Artificial Sequence
  synthetic
EIVMTQSPATLSVSPGERATLSCRASQRISSNLAWYQQKPGQAPRLLIYGASTRATGSPARFSGSGSGTEFTLTISSLQSEDVAVYYCQQHNNWPLTFGGGTKVEIK

SEQ ID NO: 435 - DNA, 18 bp, Artificial Sequence
  synthetic
cagagaattagcagcaac

SEQ ID NO: 436 - protein, 6 aa, Artificial Sequence
  synthetic
QRISSN

SEQ ID NO: 437 - DNA, 9 bp, Artificial Sequence
  synthetic
ggtgcatcc

SEQ ID NO: 438 - protein, 3 aa, Artificial Sequence
  synthetic
GAS

SEQ ID NO: 439 - DNA, 27 bp, Artificial Sequence
  synthetic
cagcaacataataactggcctctcact

SEQ ID NO: 440 - protein, 9 aa, Artificial Sequence
  synthetic
QQHNNWPLT

SEQ ID NO: 441 - DNA, 354 bp, Artificial Sequence
  synthetic
caggtgcaattggtggagtctgggggaggcgtggtccagccggggaggtccctgagactctcctgtgctgcgtctggtttcaccttcagaagttttggcatgcactgggtccgccaggctccaggcaggggactggagtgggtggcaatgatatattttgatggaaaaaataaatactatgcagactccgtgaggggccgattcaccatttccagagacaattccaagaacaccctgtatctggaaatgagtagcctgagagccgaggacacggctgtatatttctgtgcgcgagggcctgggtacaactggctcgacccctggggccagggaaccctggtcaccgtctcctca

SEQ ID NO: 442 - protein, 118 aa, Artificial Sequence; identical to SEQ ID NO: 362
  synthetic

SEQ ID NO: 443 - DNA, 24 bp, Artificial Sequence
  synthetic
ggtttcaccttcagaagttttggc

SEQ ID NO: 444 - protein, 8 aa, Artificial Sequence
  synthetic
GFTFRSFG

SEQ ID NO: 445 - DNA, 24 bp, Artificial Sequence
  synthetic
atatattttgatggaaaaaataaa

SEQ ID NO: 446 - protein, 8 aa, Artificial Sequence
  synthetic
IYFDGKNK

SEQ ID NO: 447 - DNA, 33 bp, Artificial Sequence; identical to SEQ ID NO: 303
  synthetic

SEQ ID NO: 448 - protein, 11 aa, Artificial Sequence
  synthetic
ARGPGYNWLDP

SEQ ID NO: 449 - DNA, 321 bp, Artificial Sequence
  synthetic
gaaatagtgatgacgcagtctccagccaccctgtctgtgtctccaggggaaagagtcatcctctcctgtagggccagtcagagtattagcaggaacttggcctggtaccagcaaaaacctggccaggctcccaggctcctcatctatggtgcaaccaccagggccactggtgtcccagccaggttcagtggcagtgggtctgggacagagttcactctcaccatcagcagcctacagtctgaagattttgcagttttttactgtcagcagtataataataggcctctcactttcggcggagggaccgaggtggagatcaaa

SEQ ID NO: 450 - protein, 107 aa, Artificial Sequence
  synthetic
EIVMTQSPATLSVSPGERVILSCRASQSISRNLAWYQQKPGQAPRLLIYGATTRATGVPARFSGSGSGTEFTLTISSLQSEDFAVFYCQQYNNRPLTFGGGTEVEIK

SEQ ID NO: 451 - DNA, 18 bp, Artificial Sequence
  synthetic
cagagtattagcaggaac

SEQ ID NO: 452 - protein, 6 aa, Artificial Sequence
  synthetic
QSISRN

SEQ ID NO: 453 - DNA, 9 bp, Artificial Sequence
  synthetic
ggtgcaacc

SEQ ID NO: 454 - protein, 3 aa, Artificial Sequence
  synthetic
GAT

SEQ ID NO: 455 - DNA, 27 bp, Artificial Sequence
  synthetic
cagcagtataataataggcctctcact

SEQ ID NO: 456 - protein, 9 aa, Artificial Sequence
  synthetic
QQYNNRPLT

SEQ ID NO: 457 - DNA, 354 bp, Artificial Sequence; identical to SEQ ID NO: 441
  synthetic

SEQ ID NO: 458 - protein, 118 aa, Artificial Sequence; identical to SEQ ID NO: 362
  synthetic

SEQ ID NO: 459 - DNA, 24 bp, Artificial Sequence
  synthetic
ggtttcaccttcagaagttttggc

SEQ ID NO: 460 - protein, 8 aa, Artificial Sequence
  synthetic
GFTFRSFG

SEQ ID NO: 461 - DNA, 24 bp, Artificial Sequence
  synthetic
atatattttgatggaaaaaataaa

SEQ ID NO: 462 - protein, 8 aa, Artificial Sequence
  synthetic
IYFDGKNK

SEQ ID NO: 463 - DNA, 33 bp, Artificial Sequence; identical to SEQ ID NO: 303
  synthetic

SEQ ID NO: 464 - protein, 11 aa, Artificial Sequence
  synthetic
ARGPGYNWLDP

SEQ ID NO: 465 - DNA, 321 bp, Artificial Sequence
  synthetic
gaaatagtgatgacgcagtctccagccaccctgtctgtgtctccaggggaaagagtcatcctctcctgtagggccagtcagagtattagcaggaacttggcctggtaccagcaraaacctggccaggctcccaggctcctcatctatggtgcaaccaccagggccactggtgtcccagccaggttcagtggcagtgggtctgggacagagttcactctcaccatcagcagcctacagtctgaagattttgcagttttttactgtcagcagtataataataggcctctcactttcggcggagggaccgaggtggagatcaaa

SEQ ID NO: 466 - protein, 107 aa, Artificial Sequence
  synthetic
  VARIANT 38: Xaa = Any Amino Acid
EIVMTQSPATLSVSPGERVILSCRASQSISRNLAWYQXKPGQAPRLLIYGATTRATGVPARFSGSGSGTEFTLTISSLQSEDFAVFYCQQYNNRPLTFGGGTEVEIK

SEQ ID NO: 467 - DNA, 18 bp, Artificial Sequence
  synthetic
cagagtattagcaggaac

SEQ ID NO: 468 - protein, 6 aa, Artificial Sequence
  synthetic
QSISRN

SEQ ID NO: 469 - DNA, 9 bp, Artificial Sequence
  synthetic
ggtgcaacc

SEQ ID NO: 470 - protein, 3 aa, Artificial Sequence
  synthetic
GAT

SEQ ID NO: 471 - DNA, 27 bp, Artificial Sequence
  synthetic
cagcagtataataataggcctctcact

SEQ ID NO: 472 - protein, 9 aa, Artificial Sequence
  synthetic
QQYNNRPLT

SEQ ID NO: 473 - DNA, 354 bp, Artificial Sequence; identical to SEQ ID NO: 345
  synthetic

SEQ ID NO: 474 - protein, 118 aa, Artificial Sequence; identical to SEQ ID NO: 346
  synthetic

SEQ ID NO: 475 - DNA, 24 bp, Artificial Sequence
  synthetic
ggatttaccttcagaagttatggc

SEQ ID NO: 476 - protein, 8 aa, Artificial Sequence
  synthetic
GFTFRSYG

SEQ ID NO: 477 - DNA, 24 bp, Artificial Sequence
  synthetic
atatattatgatggaaacaataaa

SEQ ID NO: 478 - protein, 8 aa, Artificial Sequence
  synthetic
IYYDGNNK

SEQ ID NO: 479 - DNA, 33 bp, Artificial Sequence; identical to SEQ ID NO: 303
  synthetic

SEQ ID NO: 480 - protein, 11 aa, Artificial Sequence
  synthetic
ARGPGYNWLDP

SEQ ID NO: 481 - DNA, 321 bp, Artificial Sequence; identical to SEQ ID NO: 353
  synthetic

SEQ ID NO: 482 - protein, 107 aa, Artificial Sequence; identical to SEQ ID NO: 354
  synthetic

SEQ ID NO: 483 - DNA, 18 bp, Artificial Sequence
  synthetic
cagagtgttagcagcaac

SEQ ID NO: 484 - protein, 6 aa, Artificial Sequence
  synthetic
QSVSSN

SEQ ID NO: 485 - DNA, 9 bp, Artificial Sequence
  synthetic
ggtgcatcc

SEQ ID NO: 486 - protein, 3 aa, Artificial Sequence
  synthetic
GAS

SEQ ID NO: 487 - DNA, 27 bp, Artificial Sequence
  synthetic
cagcagtataataacaggcctctcact

SEQ ID NO: 488 - protein, 9 aa, Artificial Sequence
  synthetic
QQYNNRPLT

SEQ ID NO: 489 - DNA, 372 bp, Artificial Sequence
  synthetic
gaagtgcagctggtggagtctgggggaggcttggtacagcctggcaggtccctgagactctcctgtgcagcctctggattcacctttgatgattattccatgcactgggtccggcaagctccagggaagggcctggagtgggtctcaggtattagttggaatagtcgtagcatagactatgcggactctgtgaagggccgattcaccatctccagagacaacgccaagaactccctgtatctgcaaatgaacagtctgagagctgaggacacggccttgtattactgtgtaaaagataatagtggctatggccgctattactactacgggatggacgtctggggccaagggaccacggtctccgtctcctca

SEQ ID NO: 490 - protein, 124 aa, Artificial Sequence
  synthetic
EVQLVESGGGLVQPGRSLRLSCAASGFTFDDYSMHWVRQAPGKGLEWVSGISWNSRSIDYADSVKGRFTISRDNAKNSLYLQMNSLRAEDTALYYCVKDNSGYGRYYYYGMDVWGQGTTVSVSS

SEQ ID NO: 491 - DNA, 24 bp, Artificial Sequence
  synthetic
ggattcacctttgatgattattcc

SEQ ID NO: 492 - protein, 8 aa, Artificial Sequence
  synthetic
GFTFDDYS

SEQ ID NO: 493 - DNA, 24 bp, Artificial Sequence
  synthetic
attagttggaatagtcgtagcata

SEQ ID NO: 494 - protein, 8 aa, Artificial Sequence
  synthetic
ISWNSRSI

SEQ ID NO: 495 - DNA, 51 bp, Artificial Sequence
  synthetic
gtaaaagataatagtggctatggccgctattactactacgggatggacgtc

SEQ ID NO: 496 - protein, 17 aa, Artificial Sequence
  synthetic
VKDNSGYGRYYYYGMDV

SEQ ID NO: 497 - DNA, 321 bp, Artificial Sequence
  synthetic
aaaatagtgatgacgcagtctcccgccaccctgtctgtgtctccaggggaaagagccaccctctcctgcagggccagtcagagtgttagcggcaacttagcctggtaccagcaaaaacctggccaggctcccaggctcctcatctatggtgcatccaccagggccactagtatcccagccaggttcagtggcagtgggtctgggacagagttcactctcaccatcagcagcctgcagtctgaagattttgcagtttatttctgtcagcactattataactggcctctcactttcggcggagggaccaaggtggagatcaga

SEQ ID NO: 498 - protein, 107 aa, Artificial Sequence
  synthetic
KIVMTQSPATLSVSPGERATLSCRASQSVSGNLAWYQQKPGQAPRLLIYGASTRATSIPARFSGSGSGTEFTLTISSLQSEDFAVYFCQHYYNWPLTFGGGTKVEIR

SEQ ID NO: 499 - DNA, 18 bp, Artificial Sequence
  synthetic
cagagtgttagcggcaac

SEQ ID NO: 500 - protein, 6 aa, Artificial Sequence
  synthetic
QSVSGN

SEQ ID NO: 501 - DNA, 9 bp, Artificial Sequence
  synthetic
ggtgcatcc

SEQ ID NO: 502 - protein, 3 aa, Artificial Sequence
  synthetic
GAS

SEQ ID NO: 503 - DNA, 27 bp, Artificial Sequence
  synthetic
cagcactattataactggcctctcact

SEQ ID NO: 504 - protein, 9 aa, Artificial Sequence
  synthetic
QHYYNWPLT

SEQ ID NO: 505 - DNA, 369 bp, Artificial Sequence; identical to SEQ ID NO: 153
  synthetic

SEQ ID NO: 506 - protein, 123 aa, Artificial Sequence; identical to SEQ ID NO: 154
  synthetic

SEQ ID NO: 507 - DNA, 24 bp, Artificial Sequence
  synthetic
ggattcacctttgatgattttacc

SEQ ID NO: 508 - protein, 8 aa, Artificial Sequence
  synthetic
GFTFDDFT

SEQ ID NO: 509 - DNA, 24 bp, Artificial Sequence
  synthetic
atcagttggaatagtggtagcata

SEQ ID NO: 510 - protein, 8 aa, Artificial Sequence
  synthetic
ISWNSGSI

SEQ ID NO: 511 - DNA, 48 bp, Artificial Sequence; identical to SEQ ID NO: 159
  synthetic

SEQ ID NO: 512 - protein, 16 aa, Artificial Sequence
  synthetic
AKDNSGYGYYYYGMDV

SEQ ID NO: 513 - DNA, 339 bp, Artificial Sequence
  synthetic
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaagctggagatcaaa

SEQ ID NO: 514 - protein, 113 aa, Artificial Sequence
  synthetic
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIK

SEQ ID NO: 515 - DNA, 36 bp, Artificial Sequence
  synthetic
cagagtgttttatacagctccaacaataagaactac

SEQ ID NO: 516 - protein, 12 aa, Artificial Sequence
  synthetic
QSVLYSSNNKNY

SEQ ID NO: 517 - DNA, 9 bp, Artificial Sequence
  synthetic
tgggcatct

SEQ ID NO: 518 - protein, 3 aa, Artificial Sequence
  synthetic
WAS

SEQ ID NO: 519 - DNA, 27 bp, Artificial Sequence
  synthetic
cagcaatattatagtactccgtacact

SEQ ID NO: 520 - protein, 9 aa, Artificial Sequence
  synthetic
QQYYSTPYT

SEQ ID NO: 521 - DNA, 369 bp, Artificial Sequence
  synthetic
caggtcaccttgaaggagtctggtcctgcgctggtgaaacccacacagaccctcacactgacctgcaccttctctgggttctcactcagcactagtggaatgtgtgtgagctggatccgtcagcccccagggaaggccctggagtggcttgcacgcattgattgggatgatgataaatactacagcacatctctgaagaccaggctcaccatctccaaggacacctccaaaaaccaggtggtccttacaatgaccaacatggaccctgtggacacagccacgtattactgtgcacggatggatatagtgggagctagaggggggtggttcgacccctggggccagggaaccctggtcaccgtctcctca

SEQ ID NO: 522 - protein, 123 aa, Artificial Sequence
  synthetic
QVTLKESGPALVKPTQTLTLTCTFSGFSLSTSGMCVSWIRQPPGKALEWLARIDWDDDKYYSTSLKTRLTISKDTSKNQVVLTMTNMDPVDTATYYCARMDIVGARGGWFDPWGQGTLVTVSS

SEQ ID NO: 523 - DNA, 30 bp, Artificial Sequence
  synthetic
gggttctcactcagcactagtggaatgtgt

SEQ ID NO: 524 - protein, 10 aa, Artificial Sequence
  synthetic
GFSLSTSGMC

SEQ ID NO: 525 - DNA, 21 bp, Artificial Sequence
  synthetic
attgattgggatgatgataaa

SEQ ID NO: 526 - protein, 7 aa, Artificial Sequence
  synthetic
IDWDDDK

SEQ ID NO: 527 - DNA, 45 bp, Artificial Sequence
  synthetic
gcacggatggatatagtgggagctagaggggggtggttcgacccc

SEQ ID NO: 528 - protein, 15 aa, Artificial Sequence
  synthetic
ARMDIVGARGGWFDP

SEQ ID NO: 529 - DNA, 321 bp, Artificial Sequence
  synthetic
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagttacccgctcactttcggcggagggaccaaggtggagatcaaa

SEQ ID NO: 530 - protein, 107 aa, Artificial Sequence
  synthetic
DIQMTQSPSSLSASVGDRVTITCRASQGISNYLAWFQQKPGKAPKSLIYAASSLQSGVPSKFSGSGSGTDFTLTISSLQPEDFATYYCQQYNSYPLTFGGGTKVEIK

SEQ ID NO: 531 - DNA, 18 bp, Artificial Sequence
  synthetic
cagggcattagcaattat

SEQ ID NO: 532 - protein, 6 aa, Artificial Sequence
  synthetic
QGISNY

SEQ ID NO: 533 - DNA, 9 bp, Artificial Sequence
  synthetic
gctgcatcc

SEQ ID NO: 534 - protein, 3 aa, Artificial Sequence
  synthetic
AAS

SEQ ID NO: 535 - DNA, 27 bp, Artificial Sequence
  synthetic
caacagtataatagttacccgctcact

SEQ ID NO: 536 - protein, 9 aa, Artificial Sequence
  synthetic
QQYNSYPLT

SEQ ID NO: 537 - DNA, 404 bp, Artificial Sequence
  synthetic
caggtgcagttggtggagtctgggggaggcgtggtccagcctgggaggtccctgagactctcctgtgctgcgtctggattcaccttcagaagttatggcatgcactgggtccgccaggctccaggcaaggggctggagtgggtggcaatgatatattatgatggaaataataaaaagtatgcagactccgtgaggggccgattcaccatttccagagacaattccaagaacacgctgtatctgcaaatgaacagcctgagagtcgaggacacggctgtgtatttctgtgcgcgagggcctgggtacaactggctcgacccctggggccagggaaccctggtcaccgtctcctcagccaaaacaacagccccacccgtttatccactggcccctggaagcttggg

SEQ ID NO: 538 - protein, 134 aa, Artificial Sequence
  synthetic
QVQLVESGGGVVQPGRSLRLSCAASGFTFRSYGMHWVRQAPGKGLEWVAMIYYDGNNKKYADSVRGRFTISRDNSKNTLYLQMNSLRVEDTAVYFCARGPGYNWLDPWGQGTLVTVSSAKTTAPPVYPLAPGSL

SEQ ID NO: 539 - DNA, 24 bp, Artificial Sequence
  synthetic
ggattcaccttcagaagttatggc

SEQ ID NO: 540 - protein, 8 aa, Artificial Sequence
  synthetic
GFTFRSYG

SEQ ID NO: 541 - DNA, 24 bp, Artificial Sequence
  synthetic
atatattatgatggaaataataaa

SEQ ID NO: 542 - protein, 8 aa, Artificial Sequence
  synthetic
IYYDGNNK

SEQ ID NO: 543 - DNA, 33 bp, Artificial Sequence; identical to SEQ ID NO: 303
  synthetic

SEQ ID NO: 544 - protein, 11 aa, Artificial Sequence
  synthetic
ARGPGYNWLDP

SEQ ID NO: 545 - DNA, 321 bp, Artificial Sequence
  synthetic
gaaatagtgatgacgcagtctccagccaccctgtctgtgtctccaggggaaagagccaccctctcctgcagggccagtcagagtgttagcaggaacttggcctggtaccagcagaaacctggccaggctcccaggctcctcatctatggtgcatccaccagggccactgatatcccagccaggttcagtggcagtgggtctgggacagagttcattctcaacatcagcagcctgcagtctgaagattttgcactttattactgtcaacaatatagtaactggcctctcactttcggcggagggaccgaggtggagatcaaa

SEQ ID NO: 546 - protein, 107 aa, Artificial Sequence
  synthetic
EIVMTQSPATLSVSPGERATLSCRASQSVSRNLAWYQQKPGQAPRLLIYGASTRATDIPARFSGSGSGTEFILNISSLQSEDFALYYCQQYSNWPLTFGGGTEVEIK

SEQ ID NO: 547 - DNA, 18 bp, Artificial Sequence
  synthetic
cagagtgttagcaggaac

SEQ ID NO: 548 - protein, 6 aa, Artificial Sequence
  synthetic
QSVSRN

SEQ ID NO: 549 - DNA, 9 bp, Artificial Sequence
  synthetic
ggtgcatcc

SEQ ID NO: 550 - protein, 3 aa, Artificial Sequence
  synthetic
GAS

SEQ ID NO: 551 - DNA, 27 bp, Artificial Sequence
  synthetic
caacaatatagtaactggcctctcact

SEQ ID NO: 552 - protein, 9 aa, Artificial Sequence
  synthetic
QQYSNWPLT

SEQ ID NO: 553 - DNA, 354 bp, Artificial Sequence; identical to SEQ ID NO: 441
  synthetic

SEQ ID NO: 554 - protein, 118 aa, Artificial Sequence; identical to SEQ ID NO: 362
  synthetic

SEQ ID NO: 555 - DNA, 24 bp, Artificial Sequence
  synthetic
ggtttcaccttcagaagttttggc

SEQ ID NO: 556 - protein, 8 aa, Artificial Sequence
  synthetic
GFTFRSFG

SEQ ID NO: 557 - DNA, 24 bp, Artificial Sequence
  synthetic
atatattttgatggaaaaaataaa

SEQ ID NO: 558 - protein, 8 aa, Artificial Sequence
  synthetic
IYFDGKNK

SEQ ID NO: 559 - DNA, 33 bp, Artificial Sequence; identical to SEQ ID NO: 303
  synthetic

SEQ ID NO: 560 - protein, 11 aa, Artificial Sequence
  synthetic
ARGPGYNWLDP

SEQ ID NO: 561 - DNA, 321 bp, Artificial Sequence
  synthetic
gaaatagtgatgacgcagtctccagccaccctgtctgtgtctccaggggaaagagtcatcctctcctgtagggccagtcagagtattagcaggaacttggcctggtaccagcagaaacctggccaggctcccaggctcctcatctatggtgcaaccaccagggccactggtgtcccagccaggttcagtggcagtgggtctgggacagagttcactctcaccatcagcagcctacagtctgaagattttgcagttttttactgtcagcagtataataataggcctctcactttcggcggagggaccgaggtggagatcaaa

SEQ ID NO: 562 - protein, 107 aa, Artificial Sequence; identical to SEQ ID NO: 450
  synthetic

SEQ ID NO: 563 - DNA, 18 bp, Artificial Sequence
  synthetic
cagagtattagcaggaac

SEQ ID NO: 564 - protein, 6 aa, Artificial Sequence
  synthetic
QSISRN

SEQ ID NO: 565 - DNA, 9 bp, Artificial Sequence
  synthetic
ggtgcaacc

SEQ ID NO: 566 - protein, 3 aa, Artificial Sequence
  synthetic
GAT

SEQ ID NO: 567 - DNA, 27 bp, Artificial Sequence
  synthetic
cagcagtataataataggcctctcact

SEQ ID NO: 568 - protein, 9 aa, Artificial Sequence
  synthetic
QQYNNRPLT

SEQ ID NO: 569 - DNA, 354 bp, Artificial Sequence; identical to SEQ ID NO: 441
  synthetic

SEQ ID NO: 570 - protein, 118 aa, Artificial Sequence; identical to SEQ ID NO: 362
  synthetic

SEQ ID NO: 571 - DNA, 24 bp, Artificial Sequence
  synthetic
ggtttcaccttcagaagttttggc

SEQ ID NO: 572 - protein, 8 aa, Artificial Sequence
  synthetic
GFTFRSFG

SEQ ID NO: 573 - DNA, 24 bp, Artificial Sequence
  synthetic
atatattttgatggaaaaaataaa

SEQ ID NO: 574 - protein, 8 aa, Artificial Sequence
  synthetic
IYFDGKNK

SEQ ID NO: 575 - DNA, 33 bp, Artificial Sequence; identical to SEQ ID NO: 303
  synthetic

SEQ ID NO: 576 - protein, 11 aa, Artificial Sequence
  synthetic
ARGPGYNWLDP

SEQ ID NO: 577 - DNA, 321 bp, Artificial Sequence; identical to SEQ ID NO: 561
  synthetic

SEQ ID NO: 578 - protein, 107 aa, Artificial Sequence; identical to SEQ ID NO: 450
  synthetic

SEQ ID NO: 579 - DNA, 18 bp, Artificial Sequence
  synthetic
cagagtattagcaggaac

SEQ ID NO: 580 - protein, 6 aa, Artificial Sequence
  synthetic
QSISRN

SEQ ID NO: 581 - DNA, 9 bp, Artificial Sequence
  synthetic
ggtgcaacc

SEQ ID NO: 582 - protein, 3 aa, Artificial Sequence
  synthetic
GAT

SEQ ID NO: 583 - DNA, 27 bp, Artificial Sequence
  synthetic
cagcagtataataataggcctctcact

SEQ ID NO: 584 - protein, 9 aa, Artificial Sequence
  synthetic
QQYNNRPLT

SEQ ID NO: 585 - DNA, 351 bp, Artificial Sequence
  synthetic
caggtgcacctggaagagtctgggggaggcgtggtccagcctgggaggtccctgagactctcctgttcagcgtctggtttcaccttcagtagttatgccatgcactgggtccgccaggctccaggcaaggggctggagtgggtggcagttatatggtatgatggaactaataaatattatttagattccgtgaagggccgattcaccatctccagagacaattccaagaacacgctgtttctgcaaatgaacagcctgagagccgaagacacggctgtgtattactgtgcgagagatcggggaagtataataacccactggggccagggaaccctggtcaccgtctcctca

SEQ ID NO: 586 - protein, 117 aa, Artificial Sequence
  synthetic
QVHLEESGGGVVQPGRSLRLSCSASGFTFSSYAMHWVRQAPGKGLEWVAVIWYDGTNKYYLDSVKGRFTISRDNSKNTLFLQMNSLRAEDTAVYYCARDRGSIITHWGQGTLVTVSS

SEQ ID NO: 587 - DNA, 24 bp, Artificial Sequence
  synthetic
ggtttcaccttcagtagttatgcc

SEQ ID NO: 588 - protein, 8 aa, Artificial Sequence
  synthetic
GFTFSSYA

SEQ ID NO: 589 - DNA, 24 bp, Artificial Sequence
  synthetic
atatggtatgatggaactaataaa

SEQ ID NO: 590 - protein, 8 aa, Artificial Sequence
  synthetic
IWYDGTNK

SEQ ID NO: 591 - DNA, 30 bp, Artificial Sequence
  synthetic
gcgagagatcggggaagtataataacccac

SEQ ID NO: 592 - protein, 10 aa, Artificial Sequence
  synthetic
ARDRGSIITH

SEQ ID NO: 593 - DNA, 324 bp, Artificial Sequence
  synthetic
gacatccagatgacccagtctccatcctccctgtctgcatctataggagacagagtcaccatcacttgccgggcaagtcagaacattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagacttacagtacccctccgatcaccttcggccaagggacacgactggagattaaa

SEQ ID NO: 594 - protein, 108 aa, Artificial Sequence
  synthetic
DIQMTQSPSSLSASIGDRVTITCRASQNISSYLNWYQQKPGKAPKLLIYAASSLQSGVPSRFSGSGSGTDFTLTISSLQPEDFATYYCQQTYSTPPITFGQGTRLEIK

SEQ ID NO: 595 - DNA, 18 bp, Artificial Sequence
  synthetic
cagaacattagcagctat

SEQ ID NO: 596 - protein, 6 aa, Artificial Sequence
  synthetic
QNISSY

SEQ ID NO: 597 - DNA, 9 bp, Artificial Sequence
  synthetic
gctgcatcc

SEQ ID NO: 598 - protein, 3 aa, Artificial Sequence
  synthetic
AAS

SEQ ID NO: 599 - DNA, 30 bp, Artificial Sequence
  synthetic
caacagacttacagtacccctccgatcacc

SEQ ID NO: 600 - protein, 10 aa, Artificial Sequence
  synthetic
QQTYSTPPIT

SEQ ID NO: 601 - DNA, 372 bp, Artificial Sequence
  synthetic
gaagtacagctggtggagtctgggggaggcttggtacggcctggcaggtccctgagactctcctgtgcagcctctggattcacctttgatgattataccatgcactgggtccgccaagctccagggaagggcctggagtgggtctcagatattagttggaatagtgggaccataggctatgcggactctgtgaagggccgattcaccatctccagagacaacgccaagaactccctgtatctgcaaatgaacagtctgagacctgaggacacggccttgtattactgtgcaaaagatatgagtggctacgcccactactactactacggtatggacgtctggggccaagggaccacggtcaccgtctcctca

SEQ ID NO: 602 - protein, 124 aa, Artificial Sequence
  synthetic
EVQLVESGGGLVRPGRSLRLSCAASGFTFDDYTMHWVRQAPGKGLEWVSDISWNSGTIGYADSVKGRFTISRDNAKNSLYLQMNSLRPEDTALYYCAKDMSGYAHYYYYGMDVWGQGTTVTVSS

SEQ ID NO: 603 - DNA, 24 bp, Artificial Sequence
  synthetic
ggattcacctttgatgattatacc

SEQ ID NO: 604 - protein, 8 aa, Artificial Sequence
  synthetic
GFTFDDYT

SEQ ID NO: 605 - DNA, 24 bp, Artificial Sequence
  synthetic
attagttggaatagtgggaccata

SEQ ID NO: 606 - protein, 8 aa, Artificial Sequence
  synthetic
ISWNSGTI

SEQ ID NO: 607 - DNA, 51 bp, Artificial Sequence
  synthetic
gcaaaagatatgagtggctacgcccactactactactacggtatggacgtc

SEQ ID NO: 608 - protein, 17 aa, Artificial Sequence
  synthetic
AKDMSGYAHYYYYGMDV

SEQ ID NO: 609 - DNA, 324 bp, Artificial Sequence
  synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 610 - protein, 108 aa, Artificial Sequence
  synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPITFGQGTRLEIK

SEQ ID NO: 611 - DNA, 18 bp, Artificial Sequence
  synthetic
cagagcattagcagctat

SEQ ID NO: 612 - protein, 6 aa, Artificial Sequence
  synthetic
QSISSY

SEQ ID NO: 613 - DNA, 9 bp, Artificial Sequence
  synthetic
gctgcatcc

SEQ ID NO: 614 - protein, 3 aa, Artificial Sequence
  synthetic
AAS

SEQ ID NO: 615 - DNA, 30 bp, Artificial Sequence; identical to SEQ ID NO: 199
  synthetic

SEQ ID NO: 616 - protein, 10 aa, Artificial Sequence
  synthetic
QQSYSTPPIT

SEQ ID NO: 617 - DNA, 372 bp, Artificial Sequence
  synthetic
gaagtgcagctggtggagtctgggggaggcttggtacagcctggcaggtccctgagactctcctgtgcagcctctggattcacctttgatgattataccatgcactgggtccggcaagctccagggaagggcctggagtgggtctccgatattagttggaatagtggtagcataggctatgcggactctgtgaagggccgattcaccgtctccagagacaacgccaagaactccctgtatctgcaaatgaacagtctgagaggtgaggacacggccctgtattactgtgcaaaagatatgagtggctacgcccactacggctactacggtatggacgtctggggccaagggaccacggtcaccgtctcctca

SEQ ID NO: 618 - protein, 124 aa, Artificial Sequence
  synthetic
EVQLVESGGGLVQPGRSLRLSCAASGFTFDDYTMHWVRQAPGKGLEWVSDISWNSGSIGYADSVKGRFTVSRDNAKNSLYLQMNSLRGEDTALYYCAKDMSGYAHYGYYGMDVWGQGTTVTVSS

SEQ ID NO: 619 - DNA, 24 bp, Artificial Sequence
  synthetic
ggattcacctttgatgattatacc

SEQ ID NO: 620 - protein, 8 aa, Artificial Sequence
  synthetic
GFTFDDYT

SEQ ID NO: 621 - DNA, 24 bp, Artificial Sequence
  synthetic
attagttggaatagtggtagcata

SEQ ID NO: 622 - protein, 8 aa, Artificial Sequence
  synthetic
ISWNSGSI

SEQ ID NO: 623 - DNA, 51 bp, Artificial Sequence
  synthetic
gcaaaagatatgagtggctacgcccactacggctactacggtatggacgtc

SEQ ID NO: 624 - protein, 17 aa, Artificial Sequence
  synthetic
AKDMSGYAHYGYYGMDV

SEQ ID NO: 625 - DNA, 324 bp, Artificial Sequence
  synthetic
gacatccagatgacccagtctccatcctccctgtctgcatctgtaggagacagagtcaccatcacttgccgggcaagtcagagcattaggaactatttaaattggtatcagcagaaaccagggaaagtccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaaccctccgatcaccttcggccaagggacacgactggagattaaa

SEQ ID NO: 626 - protein, 108 aa, Artificial Sequence
  synthetic
DIQMTQSPSSLSASVGDRVTITCRASQSIRNYLNWYQQKPGKVPKLLIYAASSLQSGVPSRFSGSGSGTDFTLTISSLQPEDFATYYCQQSYSNPPITFGQGTRLEIK

SEQ ID NO: 627 - DNA, 18 bp, Artificial Sequence
  synthetic
cagagcattaggaactat

SEQ ID NO: 628 - protein, 6 aa, Artificial Sequence
  synthetic
QSIRNY

SEQ ID NO: 629 - DNA, 9 bp, Artificial Sequence
  synthetic
gctgcatcc

SEQ ID NO: 630 - protein, 3 aa, Artificial Sequence
  synthetic
AAS

SEQ ID NO: 631 - DNA, 30 bp, Artificial Sequence
  synthetic
caacagagttacagtaaccctccgatcacc

SEQ ID NO: 632 - protein, 10 aa, Artificial Sequence
  synthetic
QQSYSNPPIT

SEQ ID NO: 633 - DNA, 369 bp, Artificial Sequence
  synthetic
gaagcgcagctggtggaatctgggggaggcttggtacagcctggcaggtccctgagactctcctgtacaacctctggattcacctttgatgattataccatgcactgggtccggcaagctccagggaagggcctggagtggatctctgatattagttggaatggtggaaccaaaggctatgcggactctgtgaagggccgattcaccatctccagagacaacgccaaaaactccctgtatctgcaaatggacagtctgagaggtgaggacacggccttatattactgtgtaaaagataaaagtggctacgggcacttctacttcggtttggacgtctggggccaagggaccacggtcaccgtctcctca

SEQ ID NO: 634 - protein, 123 aa, Artificial Sequence
  synthetic
EAQLVESGGGLVQPGRSLRLSCTTSGFTFDDYTMHWVRQAPGKGLEWISDISWNGGTKGYADSVKGRFTISRDNAKNSLYLQMDSLRGEDTALYYCVKDKSGYGHFYFGLDVWGQGTTVTVSS

SEQ ID NO: 635 - DNA, 24 bp, Artificial Sequence
  synthetic
ggattcacctttgatgattatacc

SEQ ID NO: 636 - protein, 8 aa, Artificial Sequence
  synthetic
GFTFDDYT

SEQ ID NO: 637 - DNA, 24 bp, Artificial Sequence
  synthetic
attagttggaatggtggaaccaaa

SEQ ID NO: 638 - protein, 8 aa, Artificial Sequence
  synthetic
ISWNGGTK

SEQ ID NO: 639 - DNA, 48 bp, Artificial Sequence
  synthetic
gtaaaagataaaagtggctacgggcacttctacttcggtttggacgtc

SEQ ID NO: 640 - protein, 16 aa, Artificial Sequence
  synthetic
VKDKSGYGHFYFGLDV

SEQ ID NO: 641 - DNA, 324 bp, Artificial Sequence
  synthetic
gacatccagatgacccagtctccatcctccctgactgcgtctgtaggagacagagtcaccttcacttgccgggcaagtcagagcattagcaggcatttaagttggtatcagcagaaaccagggaaagcccctaagctcctgatctatgctgcatccagtttggaaagtggggtcccttcaaggttcagtggcagtggatctgggacagatttcactctcaccatcagcagtctgcaccctgaagattttgcaacttactactgtcaacagagctacagtaaccctccgatcaccttcggccaagggacacgactggagattaaa

SEQ ID NO: 642 - protein, 108 aa, Artificial Sequence
  synthetic
DIQMTQSPSSLTASVGDRVTFTCRASQSISRHLSWYQQKPGKAPKLLIYAASSLESGVPSRFSGSGSGTDFTLTISSLHPEDFATYYCQQSYSNPPITFGQGTRLEIK

SEQ ID NO: 643 - DNA, 18 bp, Artificial Sequence
  synthetic
cagagcattagcaggcat

SEQ ID NO: 644 - protein, 6 aa, Artificial Sequence
  synthetic
QSISRH

SEQ ID NO: 645 - DNA, 9 bp, Artificial Sequence
  synthetic
gctgcatcc

SEQ ID NO: 646 - protein, 3 aa, Artificial Sequence
  synthetic
AAS

SEQ ID NO: 647 - DNA, 30 bp, Artificial Sequence
  synthetic
caacagagctacagtaaccctccgatcacc

SEQ ID NO: 648 - protein, 10 aa, Artificial Sequence
  synthetic
QQSYSNPPIT

SEQ ID NO: 649 - DNA, 369 bp, Artificial Sequence
  synthetic
gaagtgcagttggtggagtctgggggaggcttggtacagcctggcaggtccctgagactctcctgtgcagcctctggattcaagtttgctgattatgccatgcactgggtccggcaagctccagggaagggcctggagtgggtctcagagattagttggaatagtggtagcataggttatgtggactctgtgaagggccgattcaccatctccagagacaacgccaagaactccctgtatctgcaaatgaacagtctgagagctgaggacacggccttgtattactgtgtaaaagataaaagtggctacgggcactactatatcggtatggacgtctggggccaagggaccacggtcatcgtctcctcc

SEQ ID NO: 650 - protein, 123 aa, Artificial Sequence
  synthetic
EVQLVESGGGLVQPGRSLRLSCAASGFKFADYAMHWVRQAPGKGLEWVSEISWNSGSIGYVDSVKGRFTISRDNAKNSLYLQMNSLRAEDTALYYCVKDKSGYGHYYIGMDVWGQGTTVIVSS

SEQ ID NO: 651 - DNA, 24 bp, Artificial Sequence
  synthetic
ggattcaagtttgctgattatgcc

SEQ ID NO: 652 - protein, 8 aa, Artificial Sequence
  synthetic
GFKFADYA

SEQ ID NO: 653 - DNA, 24 bp, Artificial Sequence
  synthetic
attagttggaatagtggtagcata

SEQ ID NO: 654 - protein, 8 aa, Artificial Sequence
  synthetic
ISWNSGSI

SEQ ID NO: 655 - DNA, 48 bp, Artificial Sequence
  synthetic
gtaaaagataaaagtggctacgggcactactatatcggtatggacgtc

SEQ ID NO: 656 - protein, 16 aa, Artificial Sequence
  synthetic
VKDKSGYGHYYIGMDV

SEQ ID NO: 657 - DNA, 324 bp, Artificial Sequence
  synthetic
gacatccagatgacccagtctccatcctccctgtctgcatctgtaggagacagagtcaccatcacttgccgggcaagtcagagtattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 658 - protein, 108 aa, Artificial Sequence; identical to SEQ ID NO: 610
  synthetic

SEQ ID NO: 659 - DNA, 18 bp, Artificial Sequence
  synthetic
cagagtattagcagctat

SEQ ID NO: 660 - protein, 6 aa, Artificial Sequence
  synthetic
QSISSY

SEQ ID NO: 661 - DNA, 9 bp, Artificial Sequence
  synthetic
gctgcatcc

SEQ ID NO: 662 - protein, 3 aa, Artificial Sequence
  synthetic
AAS

SEQ ID NO: 663 - DNA, 30 bp, Artificial Sequence; identical to SEQ ID NO: 199
  synthetic

SEQ ID NO: 664 - protein, 10 aa, Artificial Sequence
  synthetic
QQSYSTPPIT

SEQ ID NO: 665 - DNA, 372 bp, Artificial Sequence
  synthetic
gaagtgcacctggtggagtctgggggaggcttggtacagcctggcaggtccctgagactctcctgtgcagcctctggattcacctttgatgattataccatgcactgggtccggcaagctccagggaagggcctggagtgggtctccgatattagttggaatagtggtagcataggctatgcggactctgtgaagggccgattcaccgtctccagagacaacgccaagaactccctgtatctgcaaatgaacagtctgagaggtgaggacacggccttgtattactgtgcaaaagatatgagtggctacggccactacggcaagtacggtatggacgtctggggccaagggaccacggtcaccgtctcctca

SEQ ID NO: 666 - protein, 124 aa, Artificial Sequence
  synthetic
EVHLVESGGGLVQPGRSLRLSCAASGFTFDDYTMHWVRQAPGKGLEWVSDISWNSGSIGYADSVKGRFTVSRDNAKNSLYLQMNSLRGEDTALYYCAKDMSGYGHYGKYGMDVWGQGTTVTVSS

SEQ ID NO: 667 - DNA, 24 bp, Artificial Sequence
  synthetic
ggattcacctttgatgattatacc

SEQ ID NO: 668 - protein, 8 aa, Artificial Sequence
  synthetic
GFTFDDYT

SEQ ID NO: 669 - DNA, 24 bp, Artificial Sequence
  synthetic
attagttggaatagtggtagcata

SEQ ID NO: 670 - protein, 8 aa, Artificial Sequence
  synthetic
ISWNSGSI

SEQ ID NO: 671 - DNA, 51 bp, Artificial Sequence
  synthetic
gcaaaagatatgagtggctacggccactacggcaagtacggtatggacgtc

SEQ ID NO: 672 - protein, 17 aa, Artificial Sequence
  synthetic
AKDMSGYGHYGKYGMDV

SEQ ID NO: 673 - DNA, 324 bp, Artificial Sequence
  synthetic
gacatccagatgacccagtctccatcctccctgtctgcatctgtaggagacagagtcaccatcacttgccgggcaagtcagagcattaggagctatttaaattggtatcagcagaaaccagggaaagtccctaagctcctgatctatgctgcatccagtttgcaaagtggggtcccatcaaggttcagtggcagtggatctgggacagatttcactctcaccatcaacagtctgcaacctgacgattttgcaacttactactgtcaacagacttacagtaaccctccgatcaccttcggccaagggacacgactggagattaaa

SEQ ID NO: 674 - protein, 108 aa, Artificial Sequence
  synthetic
DIQMTQSPSSLSASVGDRVTITCRASQSIRSYLNWYQQKPGKVPKLLIYAASSLQSGVPSRFSGSGSGTDFTLTINSLQPDDFATYYCQQTYSNPPITFGQGTRLEIK

SEQ ID NO: 675 - DNA, 18 bp, Artificial Sequence
  synthetic
cagagcattaggagctat

SEQ ID NO: 676 - protein, 6 aa, Artificial Sequence
  synthetic
QSIRSY

SEQ ID NO: 677 - DNA, 9 bp, Artificial Sequence
  synthetic
gctgcatcc

SEQ ID NO: 678 - protein, 3 aa, Artificial Sequence
  synthetic
AAS

SEQ ID NO: 679 - DNA, 30 bp, Artificial Sequence
  synthetic
caacagacttacagtaaccctccgatcacc

SEQ ID NO: 680 - protein, 10 aa, Artificial Sequence
  synthetic
QQTYSNPPIT

SEQ ID NO: 681 - DNA, 372 bp, Artificial Sequence
  synthetic
gaggtgcagctggtggagtctgggggagacttggtacagcctggcaggtccctgagactctcctgtgcagcctctggattcacctttgatgattataccatgcactgggtccggcaagctccagggaagggcctggagtgggtctcaattattagttggaatggtaataccattgactatgcggactctgtgaagggccgattcaccatctccagagacaacgccaagaactccctgtatcttcaaatgaacagtctgagagctgaggacacggccttgtattactgtgcaaaagataagagtggctacggacacttctactattacgttttggacgtctggggccaagggaccacggtcaccgtctcctca

SEQ ID NO: 682 - protein, 124 aa, Artificial Sequence
  synthetic
EVQLVESGGDLVQPGRSLRLSCAASGFTFDDYTMHWVRQAPGKGLEWVSIISWNGNTIDYADSVKGRFTISRDNAKNSLYLQMNSLRAEDTALYYCAKDKSGYGHFYYYVLDVWGQGTTVTVSS

SEQ ID NO: 683 - DNA, 24 bp, Artificial Sequence
  synthetic
ggattcacctttgatgattatacc

SEQ ID NO: 684 - protein, 8 aa, Artificial Sequence
  synthetic
GFTFDDYT

SEQ ID NO: 685 - DNA, 24 bp, Artificial Sequence
  synthetic
attagttggaatggtaataccatt

SEQ ID NO: 686 - protein, 8 aa, Artificial Sequence
  synthetic
ISWNGNTI

SEQ ID NO: 687 - DNA, 51 bp, Artificial Sequence
  synthetic
gcaaaagataagagtggctacggacacttctactattacgttttggacgtc

SEQ ID NO: 688 - protein, 17 aa, Artificial Sequence
  synthetic
AKDKSGYGHFYYYVLDV

SEQ ID NO: 689 - DNA, 321 bp, Artificial Sequence
  synthetic
gacatccagatgacccagtctccatcctccctgtctgcatctgtaggagacagagtcaccatcacttgccgggcaagtcagagcattaacaactatttaaattggtatcagcagaaaccagggaaagcccctaaactcctgatctatgctgcttccagtttgcaaagtggggtcccgtcaaggttcagtggcagtggttctgggacagatttcactctcaccatcagcagtctgcaacctgaagattttgcaacttactactctcaacagagttacagtttcccgtggacgttcggccaagggaccaaggtggaaatcaaa

SEQ ID NO: 690 - protein, 107 aa, Artificial Sequence
  synthetic
DIQMTQSPSSLSASVGDRVTITCRASQSINNYLNWYQQKPGKAPKLLIYAASSLQSGVPSRFSGSGSGTDFTLTISSLQPEDFATYYSQQSYSFPWTFGQGTKVEIK

SEQ ID NO: 691 - DNA, 18 bp, Artificial Sequence
  synthetic
cagagcattaacaactat

SEQ ID NO: 692 - protein, 6 aa, Artificial Sequence
  synthetic
QSINNY

SEQ ID NO: 693 - DNA, 9 bp, Artificial Sequence
  synthetic
gctgcttcc

SEQ ID NO: 694 - protein, 3 aa, Artificial Sequence
  synthetic
AAS

SEQ ID NO: 695 - DNA, 27 bp, Artificial Sequence
  synthetic
caacagagttacagtttcccgtggacg

SEQ ID NO: 696 - protein, 9 aa, Artificial Sequence
  synthetic
QQSYSFPWT

SEQ ID NO: 697 - DNA, 363 bp, Artificial Sequence
  synthetic
caggtgcagctggtggagtcggggggaggcgtggtccagcctgggaggtccctgagaccctcctgtgcagcgtctggatttagtttcagggactatggcatgcactgggtccgccaggctccaggtaagggactagagtggatggcacacatatggtataatggaaagaataaatattatgcagactccgtgaagggccgattcaccatctccagagacaattccaagaacacgctatatctgcaaatgaacagcctgagacccgaggacacggctgtatattattgtgcgagagatggtgtatcagcacgtggtactccatttgactactggggccagggaaccctggtcaccgtctcctca

SEQ ID NO: 698 - protein, 121 aa, Artificial Sequence
  synthetic
QVQLVESGGGVVQPGRSLRPSCAASGFSFRDYGMHWVRQAPGKGLEWMAHIWYNGKNKYYADSVKGRFTISRDNSKNTLYLQMNSLRPEDTAVYYCARDGVSARGTPFDYWGQGTLVTVSS

SEQ ID NO: 699 - DNA, 24 bp, Artificial Sequence
  synthetic
ggatttagtttcagggactatggc

SEQ ID NO: 700 - protein, 8 aa, Artificial Sequence
  synthetic
GFSFRDYG

SEQ ID NO: 701 - DNA, 24 bp, Artificial Sequence
  synthetic
atatggtataatggaaagaataaa

SEQ ID NO: 702 - protein, 8 aa, Artificial Sequence
  synthetic
IWYNGKNK

SEQ ID NO: 703 - DNA, 42 bp, Artificial Sequence
  synthetic
gcgagagatggtgtatcagcacgtggtactccatttgactac

SEQ ID NO: 704 - protein, 14 aa, Artificial Sequence
  synthetic
ARDGVSARGTPFDY

SEQ ID NO: 705 - DNA, 321 bp, Artificial Sequence
  synthetic
gaaacgacactcacgcagtctccagcattcatgtcagcggctccaggagacaaagtcagcatctcctgcattgccagccagtacattgatgatgatgtgaactggtaccaacagaaaccaggagaaactgctattttcattattcaagaagcttctactctcgttcctggaatctcacctcgattcagtggcagcgggtatggaacacattttaccctcacaattaataacatagattctgaggatgctgcattttacttctgtctccaacatgataatttcccgtacacttttggccaggggaccaagctggagatcaaa

SEQ ID NO: 706 - protein, 107 aa, Artificial Sequence
  synthetic
ETTLTQSPAFMSAAPGDKVSISCIASQYIDDDVNWYQQKPGETAIFIIQEASTLVPGISPRFSGSGYGTHFTLTINNIDSEDAAFYFCLQHDNFPYTFGQGTKLEIK

SEQ ID NO: 707 - DNA, 18 bp, Artificial Sequence
  synthetic
cagtacattgatgatgat

SEQ ID NO: 708 - protein, 6 aa, Artificial Sequence
  synthetic
QYIDDD

SEQ ID NO: 709 - DNA, 9 bp, Artificial Sequence
  synthetic
gaagcttct

SEQ ID NO: 710 - protein, 3 aa, Artificial Sequence
  synthetic
EAS

SEQ ID NO: 711 - DNA, 27 bp, Artificial Sequence
  synthetic
ctccaacatgataatttcccgtacact

SEQ ID NO: 712 - protein, 9 aa, Artificial Sequence
  synthetic
LQHDNFPYT

SEQ ID NO: 713 - DNA, 384 bp, Artificial Sequence
  synthetic
caggtgcagctggtggagtctgggggaggcttggtacagcctggggggtccctgagactctcctgtgcagcctcttatttcacctttagcagttttgccatgaactgggtccgccaggctccagggcagggcctggagtgggtctcagctattagtggtagggtctcagctattagtggtagtggtggtatcacatactacgcagactccgtgaagggccggttcatcatctccagagacaattccaagaacacgctgtatctgcaaatgagcggcctgagagccgaggacacggccgtatattactgtgcgaaaggcccctatttgactacagtcaccccctttgactactggggccagggaaccctggtcaccgtctcctca

SEQ ID NO: 714 - protein, 128 aa, Artificial Sequence
  synthetic
QVQLVESGGGLVQPGGSLRLSCAASYFTFSSFAMNWVRQAPGQGLEWVSAISGRVSAISGSGGITYYADSVKGRFIISRDNSKNTLYLQMSGLRAEDTAVYYCAKGPYLTTVTPFDYWGQGTLVTVSS

SEQ ID NO: 715 - DNA, 24 bp, Artificial Sequence
  synthetic
tatttcacctttagcagttttgcc

SEQ ID NO: 716 - protein, 8 aa, Artificial Sequence
  synthetic
YFTFSSFA

SEQ ID NO: 717 - DNA, 24 bp, Artificial Sequence
  synthetic
attagtggtagtggtggtatcaca

SEQ ID NO: 718 - protein, 8 aa, Artificial Sequence
  synthetic
ISGSGGIT

SEQ ID NO: 719 - DNA, 42 bp, Artificial Sequence
  synthetic
gcgaaaggcccctatttgactacagtcaccccctttgactac

SEQ ID NO: 720 - protein, 14 aa, Artificial Sequence
  synthetic
AKGPYLTTVTPFDY

SEQ ID NO: 721 - DNA, 324 bp, Artificial Sequence
  synthetic
gacatccagttgacccagtctccatcttccgtgtctgcatctgtcggagacagagtcaccatcacttgtcgggcgagtcaggggattagcagctggttagcctggtatcagcagaaaccagggaaagcccctaaactcctgatctatgctgtatccagtttgcaaaatggggtcccatcaaggttcagcggcagtggatctgggacagatttcaccctcaccatcagcagcctgcagcctgaagactttgcaacttactattgtcaacaggctaacagtttcccattcactttcggccctgggaccaagctggagatcaaacga

SEQ ID NO: 722 - protein, 108 aa, Artificial Sequence
  synthetic
DIQLTQSPSSVSASVGDRVTITCRASQGISSWLAWYQQKPGKAPKLLIYAVSSLQNGVPSRFSGSGSGTDFTLTISSLQPEDFATYYCQQANSFPFTFGPGTKLEIKR

SEQ ID NO: 723 - DNA, 18 bp, Artificial Sequence
  synthetic
caggggattagcagctgg

SEQ ID NO: 724 - protein, 6 aa, Artificial Sequence
  synthetic
QGISSW

SEQ ID NO: 725 - DNA, 9 bp, Artificial Sequence
  synthetic
gctgtatcc

SEQ ID NO: 726 - protein, 3 aa, Artificial Sequence
  synthetic
AVS

SEQ ID NO: 727 - DNA, 27 bp, Artificial Sequence
  synthetic
caacaggctaacagtttcccattcact

SEQ ID NO: 728 - protein, 9 aa, Artificial Sequence
  synthetic
QQANSFPFT

SEQ ID NO: 729 - DNA, 369 bp, Artificial Sequence
  synthetic
gaggtgcagctggtggagtctgggggaggcttggtacagcctggcaggtccctgagactctcctgtgcagcctctggattcacctttgctgattatgccatgcactgggtccggcaagctccagggaagggcctggagtgggtctcaggtattagttggaatagtggtagtataggttatgcggactctgtgaagggccgattcaccatctccagagacaacgccaagaactccctgtatctgcaaatgaacagtctgagagctgaggacacggccttatattactgtgtaaaagataatagtggctacgcatcctactactacggtatggacgtctggggccaagggaccacggtcaccgtctcctca

SEQ ID NO: 730 - protein, 123 aa, Artificial Sequence
  synthetic
EVQLVESGGGLVQPGRSLRLSCAASGFTFADYAMHWVRQAPGKGLEWVSGISWNSGSIGYADSVKGRFTISRDNAKNSLYLQMNSLRAEDTALYYCVKDNSGYASYYYGMDVWGQGTTVTVSS

SEQ ID NO: 731 - DNA, 24 bp, Artificial Sequence
  synthetic
ggattcacctttgctgattatgcc

SEQ ID NO: 732 - protein, 8 aa, Artificial Sequence
  synthetic
GFTFADYA

SEQ ID NO: 733 - DNA, 24 bp, Artificial Sequence
  synthetic
attagttggaatagtggtagtata

SEQ ID NO: 734 - protein, 8 aa, Artificial Sequence
  synthetic
ISWNSGSI

SEQ ID NO: 735 - DNA, 48 bp, Artificial Sequence
  synthetic
gtaaaagataatagtggctacgcatcctactactacggtatggacgtc

SEQ ID NO: 736 - protein, 16 aa, Artificial Sequence
  synthetic
VKDNSGYASYYYGMDV

SEQ ID NO: 737 - DNA, 324 bp, Artificial Sequence
  synthetic
gacatccagttgacccagtccccatcctccctgtctgcatctgtaggagacagagtcaccatcacttgccgggcaagtcagagcattagcagctatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccattcactttcggccctgggaccaaagtggatatcaaacga

SEQ ID NO: 738 - protein, 108 aa, Artificial Sequence
  synthetic
DIQLTQSPSSLSASVGDRVTITCRASQSISSYLNWYQQKPGKAPKLLIYDASNLETGVPSRFSGSGSGTDFTFTISSLQPEDIATYYCQQYDNLPFTFGPGTKVDIKR

SEQ ID NO: 739 - DNA, 18 bp, Artificial Sequence
  synthetic
cagagcattagcagctat

SEQ ID NO: 740 - protein, 6 aa, Artificial Sequence
  synthetic
QSISSY

SEQ ID NO: 741 - DNA, 9 bp, Artificial Sequence
  synthetic
gatgcatcc

SEQ ID NO: 742 - protein, 3 aa, Artificial Sequence
  synthetic
DAS

SEQ ID NO: 743 - DNA, 27 bp, Artificial Sequence
  synthetic
caacagtatgataatctcccattcact

SEQ ID NO: 744 - protein, 9 aa, Artificial Sequence
  synthetic
QQYDNLPFT

SEQ ID NO: 745 - DNA, 378 bp, Artificial Sequence
  synthetic
gaggtgcagctggtggagtctgggggaggcgtggtccagcctgggaggtccctgagactctcctgtgcagcctctggattcaccttcagtaactatggcatgcactgggtccgccaggctccaggcaaagggctggagtgggtgacagttatattacatgatggaagttataaatactatgcagactccgtgaagggccgattcaccatctccagagacaattccaagaacacgctacatctgcaaatgaacagcctgagaactgaggacacggctgtatattactgtgcgaaagggcctatgtttcggggagtcccttacaaccactactatggtatggacgtctggggccaagggaccacggtcaccgtctcctca

SEQ ID NO: 746 - protein, 126 aa, Artificial Sequence
  synthetic
EVQLVESGGGVVQPGRSLRLSCAASGFTFSNYGMHWVRQAPGKGLEWVTVILHDGSYKYYADSVKGRFTISRDNSKNTLHLQMNSLRTEDTAVYYCAKGPMFRGVPYNHYYGMDVWGQGTTVTVSS

SEQ ID NO: 747 - DNA, 24 bp, Artificial Sequence
  synthetic
ggattcaccttcagtaactatggc

SEQ ID NO: 748 - protein, 8 aa, Artificial Sequence
  synthetic
GFTFSNYG

SEQ ID NO: 749 - DNA, 24 bp, Artificial Sequence
  synthetic
atattacatgatggaagttataaa

SEQ ID NO: 750 - protein, 8 aa, Artificial Sequence
  synthetic
ILHDGSYK

SEQ ID NO: 751 - DNA, 57 bp, Artificial Sequence
  synthetic
gcgaaagggcctatgtttcggggagtcccttacaaccactactatggtatggacgtc

SEQ ID NO: 752 - protein, 19 aa, Artificial Sequence
  synthetic
AKGPMFRGVPYNHYYGMDV

SEQ ID NO: 753 - DNA, 324 bp, Artificial Sequence
  synthetic
gacatccagatgacccagtctccatcctccctgtctgcatctgtaggagacagagtcaccatcacttgccgggcaagtcagggcatcagaaatgatttaggctggtatcagcagaaaccagggaaagcccctaagcgcctgatctatgctgcatccagtttgcaaagtggggtctcatcaaggttcagcggcagtggatctgggacagaattcactctcacaatcagcagcctgcagcctgaagattttgcaacttattactgtctacagcataatagttacccgtacacttttggccaggggaccaaggtggaaatcaaacga

SEQ ID NO: 754 - protein, 108 aa, Artificial Sequence
  synthetic
DIQMTQSPSSLSASVGDRVTITCRASQGIRNDLGWYQQKPGKAPKRLIYAASSLQSGVSSRFSGSGSGTEFTLTISSLQPEDFATYYCLQHNSYPYTFGQGTKVEIKR

SEQ ID NO: 755 - DNA, 18 bp, Artificial Sequence
  synthetic
cagggcatcagaaatgat

SEQ ID NO: 756 - protein, 6 aa, Artificial Sequence
  synthetic
QGIRND

SEQ ID NO: 757 - DNA, 9 bp, Artificial Sequence
  synthetic
gctgcatcc

SEQ ID NO: 758 - protein, 3 aa, Artificial Sequence
  synthetic
AAS

SEQ ID NO: 759 - DNA, 27 bp, Artificial Sequence
  synthetic
ctacagcataatagttacccgtacact

SEQ ID NO: 760 - protein, 9 aa, Artificial Sequence
  synthetic
LQHNSYPYT

SEQ ID NO: 761 - DNA, 357 bp, Artificial Sequence
  synthetic
gaggtgcagctggtggagtctgggggaggcgtggtccagcctgggaggtccctgagactctcctgtacagcgtcaggtttccccttcagtcgctatggcatgcactgggtccgccaggctccaggcaaggggctggaatgggtgacatttatatggtatgatggaagtaataaatactatgcagactccgcgaagggccgattcaccatcaccagagacaattccaagaacacggtgtatctgcaaatggacagcctgagagccgatgacacggctgtttattattgtgtgagagatcaggcagctctctactattttgactcttggggccagggaaccctggtcaccgtctcctca

SEQ ID NO: 762 - protein, 119 aa, Artificial Sequence
  synthetic
EVQLVESGGGVVQPGRSLRLSCTASGFPFSRYGMHWVRQAPGKGLEWVTFIWYDGSNKYYADSAKGRFTITRDNSKNTVYLQMDSLRADDTAVYYCVRDQAALYYFDSWGQGTLVTVSS

SEQ ID NO: 763 - DNA, 24 bp, Artificial Sequence
  synthetic
ggtttccccttcagtcgctatggc

SEQ ID NO: 764 - protein, 8 aa, Artificial Sequence
  synthetic
GFPFSRYG

SEQ ID NO: 765 - DNA, 24 bp, Artificial Sequence
  synthetic
atatggtatgatggaagtaataaa

SEQ ID NO: 766 - protein, 8 aa, Artificial Sequence
  synthetic
IWYDGSNK

SEQ ID NO: 767 - DNA, 36 bp, Artificial Sequence
  synthetic
gtgagagatcaggcagctctctactattttgactct

SEQ ID NO: 768 - protein, 12 aa, Artificial Sequence
  synthetic
VRDQAALYYFDS

SEQ ID NO: 769 - DNA, 324 bp, Artificial Sequence
  synthetic
gacatccagatgacccagtctccatcttccgtgtctgcatctgtaggagacagagtcaccatcacttgtcgggcgagtcagggtattagcaggtggttagcctggtatcagcagaaaccagggaaagcccctaagctcctgatctctgctgcatccagtttgcaaagtggagtcccatcaaggttcagcggcagtggatctgggacagatttcactctcaccatcagcggcctgcagcctgaagattttgcaacttactattgtcaaaaggctaacagtttccctttcactttcggccctgggaccaagctggagatcaaacga

SEQ ID NO: 770 - protein, 108 aa, Artificial Sequence
  synthetic
DIQMTQSPSSVSASVGDRVTITCRASQGISRWLAWYQQKPGKAPKLLISAASSLQSGVPSRFSGSGSGTDFTLTISGLQPEDFATYYCQKANSFPFTFGPGTKLEIKR

SEQ ID NO: 771 - DNA, 18 bp, Artificial Sequence
  synthetic
cagggtattagcaggtgg

SEQ ID NO: 772 - protein, 6 aa, Artificial Sequence
  synthetic
QGISRW

SEQ ID NO: 773 - DNA, 9 bp, Artificial Sequence
  synthetic
gctgcatcc

SEQ ID NO: 774 - protein, 3 aa, Artificial Sequence
  synthetic
AAS

SEQ ID NO: 775 - DNA, 27 bp, Artificial Sequence
  synthetic
caaaaggctaacagtttccctttcact

SEQ ID NO: 776 - protein, 9 aa, Artificial Sequence
  synthetic
QKANSFPFT

SEQ ID NO: 777 - DNA, 378 bp, Artificial Sequence
  synthetic
gaggtgcagctggtggagtctgggggaggcgtggtccagcctgggaggtccctgagactctcctgtgcagcctctggattcaccttcagtagttatggcatgcactgggtccgccaggctccaggcaaggggctggagtgggtgacagttatattacatgatggaagtaatagatactctgcagactccgtgaagggccgattcaccatctccagagacaattccaagaacacgctttatctgcaaatgaacatcctgagagttgaggacacggctgtgtattactgtacgaaaggggctatggttcggggagtcccttacaatcactactacggcatggacgtctggggccaagggaccacggtcaccgtctcctca

SEQ ID NO: 778 - protein, 126 aa, Artificial Sequence
  synthetic
EVQLVESGGGVVQPGRSLRLSCAASGFTFSSYGMHWVRQAPGKGLEWVTVILHDGSNRYSADSVKGRFTISRDNSKNTLYLQMNILRVEDTAVYYCTKGAMVRGVPYNHYYGMDVWGQGTTVTVSS

SEQ ID NO: 779 - DNA, 24 bp, Artificial Sequence
  synthetic
ggattcaccttcagtagttatggc

SEQ ID NO: 780 - protein, 8 aa, Artificial Sequence
  synthetic
GFTFSSYG

SEQ ID NO: 781 - DNA, 24 bp, Artificial Sequence
  synthetic
atattacatgatggaagtaataga

SEQ ID NO: 782 - protein, 8 aa, Artificial Sequence
  synthetic
ILHDGSNR

SEQ ID NO: 783 - DNA, 57 bp, Artificial Sequence
  synthetic
acgaaaggggctatggttcggggagtcccttacaatcactactacggcatggacgtc

SEQ ID NO: 784 - protein, 19 aa, Artificial Sequence
  synthetic
TKGAMVRGVPYNHYYGMDV

SEQ ID NO: 785 - DNA, 324 bp, Artificial Sequence
  synthetic
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctaatctatgctgcatccattttgcaaagtggggtcccatcaaggttcagcggcagtggatctgggacagaattcactctcacaatcagcagcctgcagcctgaagattttgcaacttattactgtctacagcataatagttacccgtacacttttggccaggggaccaagctggagatcaaacga

SEQ ID NO: 786 - protein, 108 aa, Artificial Sequence
  synthetic
DIQMTQSPSSLSASVGDRVTITCRASQGIRNDLGWYQQKPGKAPKRLIYAASILQSGVPSRFSGSGSGTEFTLTISSLQPEDFATYYCLQHNSYPYTFGQGTKLEIKR

SEQ ID NO: 787 - DNA, 18 bp, Artificial Sequence
  synthetic
cagggcattagaaatgat

SEQ ID NO: 788 - protein, 6 aa, Artificial Sequence
  synthetic
QGIRND

SEQ ID NO: 789 - DNA, 9 bp, Artificial Sequence
  synthetic
gctgcatcc

SEQ ID NO: 790 - protein, 3 aa, Artificial Sequence
  synthetic
AAS

SEQ ID NO: 791 - DNA, 27 bp, Artificial Sequence
  synthetic
ctacagcataatagttacccgtacact

SEQ ID NO: 792 - protein, 9 aa, Artificial Sequence
  synthetic
LQHNSYPYT

SEQ ID NO: 793 - DNA, 378 bp, Artificial Sequence
  synthetic
gaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtgacagttatattacatgatggaagtaatagatactatgcagactccgtgaagggccgattcaccatctccagagacaattccaagaacacgctttatctgcaaatgaacatcctgagagctgaggacacggctgtgtattactgtacgaaaggggctatggttcggggagtcccttacaatcactactacggcatggacgtctggggccaagggaccacggtcaccgtctcctca

SEQ ID NO: 794 - protein, 126 aa, Artificial Sequence
  synthetic
EVQLVESGGGVVQPGRSLRLSCAASGFTFSSYGMHWVRQAPGKGLEWVTVILHDGSNRYYADSVKGRFTISRDNSKNTLYLQMNILRAEDTAVYYCTKGAMVRGVPYNHYYGMDVWGQGTTVTVSS

SEQ ID NO: 795 - DNA, 24 bp, Artificial Sequence
  synthetic
ggattcaccttcagtagctatggc

SEQ ID NO: 796 - protein, 8 aa, Artificial Sequence
  synthetic
GFTFSSYG

SEQ ID NO: 797 - DNA, 24 bp, Artificial Sequence
  synthetic
atattacatgatggaagtaataga

SEQ ID NO: 798 - protein, 8 aa, Artificial Sequence
  synthetic
ILHDGSNR

SEQ ID NO: 799 - DNA, 57 bp, Artificial Sequence; identical to SEQ ID NO: 783
  synthetic

SEQ ID NO: 800 - protein, 19 aa, Artificial Sequence
  synthetic
TKGAMVRGVPYNHYYGMDV

SEQ ID NO: 801 - DNA, 324 bp, Artificial Sequence
  synthetic
gacatcgtgatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccaatttgcaaagtggggtcccatcaaggttcagcggcagtggatctgggacagaattcactctcacaatcagcagcctgcagcctgaagattttgcaacttattactgtctacagcataatagttacccgtacacttttggccaggggaccaagctggagatcaaacga

SEQ ID NO: 802 - protein, 108 aa, Artificial Sequence
  synthetic
DIVMTQSPSSLSASVGDRVTITCRASQGIRNDLGWYQQKPGKAPKRLIYAASNLQSGVPSRFSGSGSGTEFTLTISSLQPEDFATYYCLQHNSYPYTFGQGTKLEIKR

SEQ ID NO: 803 - DNA, 18 bp, Artificial Sequence
  synthetic
cagggcattagaaatgat

SEQ ID NO: 804 - protein, 6 aa, Artificial Sequence
  synthetic
QGIRND

SEQ ID NO: 805 - DNA, 9 bp, Artificial Sequence
  synthetic
gctgcatcc

SEQ ID NO: 806 - protein, 3 aa, Artificial Sequence
  synthetic
AAS

SEQ ID NO: 807 - DNA, 27 bp, Artificial Sequence
  synthetic
ctacagcataatagttacccgtacact

SEQ ID NO: 808 - protein, 9 aa, Artificial Sequence
  synthetic
LQHNSYPYT

SEQ ID NO: 809 - DNA, 378 bp, Artificial Sequence
  synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagactattccaagaacacgctgtatctgcaaatgaacagcctgagagctgaggacacggctgtgttttactgtgcgaaaggggctatggttcggggagtcccttacaactactactacggtatggacgtctggggccaagggaccacggtcaccgtctcctca

SEQ ID NO: 810 - protein, 126 aa, Artificial Sequence
  synthetic
QVQLVESGGGVVQPGRSLRLSCAASGFTFSSYGMHWVRQAPGKGLEWVAVISYDGSNKYYADSVKGRFTISRDYSKNTLYLQMNSLRAEDTAVFYCAKGAMVRGVPYNYYYGMDVWGQGTTVTVSS

SEQ ID NO: 811 - DNA, 24 bp, Artificial Sequence
  synthetic
ggattcaccttcagtagctatggc

SEQ ID NO: 812 - protein, 8 aa, Artificial Sequence
  synthetic
GFTFSSYG

SEQ ID NO: 813 - DNA, 24 bp, Artificial Sequence
  synthetic
atatcatatgatggaagtaataaa

SEQ ID NO: 814 - protein, 8 aa, Artificial Sequence
  synthetic
ISYDGSNK

SEQ ID NO: 815 - DNA, 57 bp, Artificial Sequence
  synthetic
gcgaaaggggctatggttcggggagtcccttacaactactactacggtatggacgtc

SEQ ID NO: 816 - protein, 19 aa, Artificial Sequence
  synthetic
AKGAMVRGVPYNYYYGMDV

SEQ ID NO: 817 - DNA, 321 bp, Artificial Sequence
  synthetic
gacatccagatgacccagtctccatcctccctgtctgcatctgtaggagacagagtcaccatcacttgccgggcaagtcagggcattagaaatgatttaggctggtttcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgtacacttttggccaggggaccaagctggagatcaaa

SEQ ID NO: 818 - protein, 107 aa, Artificial Sequence
  synthetic
DIQMTQSPSSLSASVGDRVTITCRASQGIRNDLGWFQQKPGKAPKRLIYAASSLQSGVPSRFSGSGSGTEFTLTISSLQPEDFATYYCLQHNSYPYTFGQGTKLEIK

SEQ ID NO: 819 - DNA, 18 bp, Artificial Sequence
  synthetic
cagggcattagaaatgat

SEQ ID NO: 820 - protein, 6 aa, Artificial Sequence
  synthetic
QGIRND

SEQ ID NO: 821 - DNA, 9 bp, Artificial Sequence
  synthetic
gctgcatcc

SEQ ID NO: 822 - protein, 3 aa, Artificial Sequence
  synthetic
AAS

SEQ ID NO: 823 - DNA, 27 bp, Artificial Sequence
  synthetic
ctacagcataatagttacccgtacact

SEQ ID NO: 824 - protein, 9 aa, Artificial Sequence
  synthetic
LQHNSYPYT

SEQ ID NO: 825 - DNA, 378 bp, Artificial Sequence
  synthetic
caggtgcagctggtggagtctgggggaggcgtggtccagcctgggaggtccctgagactctcctgtgcagcctctggactcaccttcagtagctatggcatgcactgggtccgccaggctccaggcaaggggctggagtgggtggcagttatatcatatgatggaagtaataaatactatacagactccgtgaagggccgattcaccatctccagagacaattctaagaacacgctgtatctgcaaatgaacagcctgagagctgaggacacggctgtgtattactgtgcgaaaggggccatggttcggggagtcccttacaactactactacggtatggacgtctggggccaagggaccacggtcaccgtctcctca

SEQ ID NO: 826 - protein, 126 aa, Artificial Sequence
  synthetic
QVQLVESGGGVVQPGRSLRLSCAASGLTFSSYGMHWVRQAPGKGLEWVAVISYDGSNKYYTDSVKGRFTISRDNSKNTLYLQMNSLRAEDTAVYYCAKGAMVRGVPYNYYYGMDVWGQGTTVTVSS

SEQ ID NO: 827 - DNA, 24 bp, Artificial Sequence
  synthetic
ggactcaccttcagtagctatggc

SEQ ID NO: 828 - protein, 8 aa, Artificial Sequence
  synthetic
GLTFSSYG

SEQ ID NO: 829 - DNA, 24 bp, Artificial Sequence
  synthetic
atatcatatgatggaagtaataaa

SEQ ID NO: 830 - protein, 8 aa, Artificial Sequence
  synthetic
ISYDGSNK

SEQ ID NO: 831 - DNA, 57 bp, Artificial Sequence
  synthetic
gcgaaaggggccatggttcggggagtcccttacaactactactacggtatggacgtc

SEQ ID NO: 832 - protein, 19 aa, Artificial Sequence
  synthetic
AKGAMVRGVPYNYYYGMDV

SEQ ID NO: 833 - DNA, 321 bp, Artificial Sequence
  synthetic
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcgtccagtttgcaaagtggggtcccatcaaggttcagcggcagtggatctgggacagaattcactctcacaatcagcagcctgcagcctgaagattttgcaacttattactgtctacagcataatagttacccgtacacttttggccaggggaccaagctggagatcaaa

SEQ ID NO: 834 - protein, 107 aa, Artificial Sequence
  synthetic
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPYTFGQGTKLEIK

SEQ ID NO: 835 - DNA, 18 bp, Artificial Sequence
  synthetic
cagggcattagaaatgat

SEQ ID NO: 836 - protein, 6 aa, Artificial Sequence
  synthetic
QGIRND

SEQ ID NO: 837 - DNA, 9 bp, Artificial Sequence
  synthetic
gctgcgtcc

SEQ ID NO: 838 - protein, 3 aa, Artificial Sequence
  synthetic
AAS

SEQ ID NO: 839 - DNA, 27 bp, Artificial Sequence
  synthetic
ctacagcataatagttacccgtacact

SEQ ID NO: 840 - protein, 9 aa, Artificial Sequence
  synthetic
LQHNSYPYT

SEQ ID NO: 841 - DNA, 378 bp, Artificial Sequence
  synthetic
caggtgcagctggtggagtctgggggaggcgtggtccagcctgggaggtccctgagactctcctgtgcagcctctggattcaccttcaggagctttggcatgcactgggtccgccaggctccaggcaaggggctggagtgggtggcagttatttcatatgatggaaattataaatactatgcagactccgtgaagggccgattcaccatctccagagacaattccaagaacacgctgtatctgcaaatgaacagcctgagagctgaggacacggctgtacattactgtgcgaaaggggctatggttcggggagtcccttacaacttctactacggtatggacgtctggggccaagggaccacggtcaccgtctcctca

SEQ ID NO: 842 - protein, 126 aa, Artificial Sequence
  synthetic
QVQLVESGGGVVQPGRSLRLSCAASGFTFRSFGMHWVRQAPGKGLEWVAVISYDGNYKYYADSVKGRFTISRDNSKNTLYLQMNSLRAEDTAVHYCAKGAMVRGVPYNFYYGMDVWGQGTTVTVSS

SEQ ID NO: 843 - DNA, 24 bp, Artificial Sequence
  synthetic
ggattcaccttcaggagctttggc

SEQ ID NO: 844 - protein, 8 aa, Artificial Sequence
  synthetic
GFTFRSFG

SEQ ID NO: 845 - DNA, 24 bp, Artificial Sequence
  synthetic
atttcatatgatggaaattataaa

SEQ ID NO: 846 - protein, 8 aa, Artificial Sequence
  synthetic
ISYDGNYK

SEQ ID NO: 847 - DNA, 57 bp, Artificial Sequence
  synthetic
gcgaaaggggctatggttcggggagtcccttacaacttctactacggtatggacgtc

SEQ ID NO: 848 - protein, 19 aa, Artificial Sequence
  synthetic
AKGAMVRGVPYNFYYGMDV

SEQ ID NO: 849 - DNA, 321 bp, Artificial Sequence
  synthetic
gacatccagatgacccagtctccatcctccctgtctgcatctgtaggagacagagtcaccatcacttgccgggcaagtcaggtcattagaaatgatttaggctggtatcagcagaaaccagggaaagcccctaagcgcctgatctatgctgcatccagtttgcaaagtgggatcccatcaaggttcagcggcagtggatctgggacagaattcactctcacaatcagcagcctgcagcctgaagattttgcaacttattactgtctacagcataatagttacccgtacacttttggccaggggaccaagctggagatcaaa

SEQ ID NO: 850 - protein, 107 aa, Artificial Sequence
  synthetic
DIQMTQSPSSLSASVGDRVTITCRASQVIRNDLGWYQQKPGKAPKRLIYAASSLQSGIPSRFSGSGSGTEFTLTISSLQPEDFATYYCLQHNSYPYTFGQGTKLEIK

SEQ ID NO: 851 - DNA, 18 bp, Artificial Sequence
  synthetic
caggtcattagaaatgat

SEQ ID NO: 852 - protein, 6 aa, Artificial Sequence
  synthetic
QVIRND

SEQ ID NO: 853 - DNA, 9 bp, Artificial Sequence
  synthetic
gctgcatcc

SEQ ID NO: 854 - protein, 3 aa, Artificial Sequence
  synthetic
AAS

SEQ ID NO: 855 - DNA, 27 bp, Artificial Sequence
  synthetic
ctacagcataatagttacccgtacact

SEQ ID NO: 856 - protein, 9 aa, Artificial Sequence
  synthetic
LQHNSYPYT

SEQ ID NO: 857 - DNA, 369 bp, Artificial Sequence
  synthetic
gaggtgcagctggtggagtctgggggaggcttggtacagcctggcaggtccctgagactctcctgtgcagcctctggattcacctttgatgattataccatgcactgggtccggcaagttccaggaaagggcctggagtggatctcaggtattagttggaatagtggtagcatggactatgcggactctgtgaagggccgattcaccatctctagagacaacgccaggaactccctgtttctgcaaatgaacagtgtgagaactgaggacacggccttgtattactgtgcaaaagataagagtggctacggctccttctactacggtatggacgtctggggccaggggaccacggtcaccgtctcctca

SEQ ID NO: 858 - protein, 123 aa, Artificial Sequence
  synthetic
EVQLVESGGGLVQPGRSLRLSCAASGFTFDDYTMHWVRQVPGKGLEWISGISWNSGSMDYADSVKGRFTISRDNARNSLFLQMNSVRTEDTALYYCAKDKSGYGSFYYGMDVWGQGTTVTVSS

SEQ ID NO: 859 - DNA, 24 bp, Artificial Sequence
  synthetic
ggattcacctttgatgattatacc

SEQ ID NO: 860 - protein, 8 aa, Artificial Sequence
  synthetic
GFTFDDYT

SEQ ID NO: 861 - DNA, 24 bp, Artificial Sequence
  synthetic
attagttggaatagtggtagcatg

SEQ ID NO: 862 - protein, 8 aa, Artificial Sequence
  synthetic
ISWNSGSM

SEQ ID NO: 863 - DNA, 48 bp, Artificial Sequence
  synthetic
gcaaaagataagagtggctacggctccttctactacggtatggacgtc

SEQ ID NO: 864 - protein, 16 aa, Artificial Sequence
  synthetic
AKDKSGYGSFYYGMDV

SEQ ID NO: 865 - DNA, 324 bp, Artificial Sequence
  synthetic
gaaattgtgttgacgcagtctccaggcaccctgtctttgtctccaggggacagagccaccctctcctgcagggccagtcagagtgtcagcagcatctacttagcctggtaccagcagaaacctggccaggctcccaggctcctcatccatggtgcgtccaccagggccactggcatcccagacaggttcagtggcagtgggtcagggacagacttcactctcaccatcagcagactggagcctgaagattttgcagtttattactgtcagcagcgtgctcactcaccgtacacttttggccaggggaccaagctggagatcaaa

SEQ ID NO: 866 - protein, 108 aa, Artificial Sequence
  synthetic
EIVLTQSPGTLSLSPGDRATLSCRASQSVSSIYLAWYQQKPGQAPRLLIHGASTRATGIPDRFSGSGSGTDFTLTISRLEPEDFAVYYCQQRAHSPYTFGQGTKLEIK

SEQ ID NO: 867 - DNA, 21 bp, Artificial Sequence
  synthetic
cagagtgtcagcagcatctac

SEQ ID NO: 868 - protein, 7 aa, Artificial Sequence
  synthetic
QSVSSIY

SEQ ID NO: 869 - DNA, 9 bp, Artificial Sequence
  synthetic
ggtgcgtcc

SEQ ID NO: 870 - protein, 3 aa, Artificial Sequence
  synthetic
GAS

SEQ ID NO: 871 - DNA, 27 bp, Artificial Sequence
  synthetic
cagcagcgtgctcactcaccgtacact

SEQ ID NO: 872 - protein, 9 aa, Artificial Sequence
  synthetic
QQRAHSPYT

SEQ ID NO: 873 - DNA, 369 bp, Artificial Sequence
  synthetic
gaagtgcagctggtggagtctgggggaggcttggtacagcctggcaggtccctgagactctcctgtgcagcctctggcttcagctttgataattatgccatgcactgggtccggcaagctccaggacagggcctggagtgggtctcaggtattagttggaatagtggtagcagagactatgcggactctgtgaagggccgattcaccatctccagagacaatgccaggaactccctgtttctgcaaatgaacagtctgagtaatgaggacacggccatgtattactgcgcaaaagataagagtggctacggctcctacttctacggtatggacgtctggggccaagggaccacggtcaccgtctcctca

SEQ ID NO: 874 - protein, 123 aa, Artificial Sequence
  synthetic
EVQLVESGGGLVQPGRSLRLSCAASGFSFDNYAMHWVRQAPGQGLEWVSGISWNSGSRDYADSVKGRFTISRDNARNSLFLQMNSLSNEDTAMYYCAKDKSGYGSYFYGMDVWGQGTTVTVSS

SEQ ID NO: 875 - DNA, 24 bp, Artificial Sequence
  synthetic
ggcttcagctttgataattatgcc

SEQ ID NO: 876 - protein, 8 aa, Artificial Sequence
  synthetic
GFSFDNYA

SEQ ID NO: 877 - DNA, 24 bp, Artificial Sequence
  synthetic
attagttggaatagtggtagcaga

SEQ ID NO: 878 - protein, 8 aa, Artificial Sequence
  synthetic
ISWNSGSR

SEQ ID NO: 879 - DNA, 48 bp, Artificial Sequence
  synthetic
gcaaaagataagagtggctacggctcctacttctacggtatggacgtc

SEQ ID NO: 880 - protein, 16 aa, Artificial Sequence
  synthetic
AKDKSGYGSYFYGMDV

SEQ ID NO: 881 - DNA, 324 bp, Artificial Sequence
  synthetic
gaaattgtgttgacgcagtctccaggcaccctgtctttgtctccaggggacagagccaccctctcctgcagggccagtcagagtattagaaacatctatttagcctggtaccagcagaaacctggccaggctcccaggctcctcatccatggtgcgtccaccagggccactggcatcccagacaggttcagtggcagtgggtcagggacagacttcactctcaccatcagcagactggagcctgaagattttgcagtttattactgtcagcagcgtgttagtttaccgtacacttttggccaggggaccaagctggagatcaaa

SEQ ID NO: 882 - protein, 108 aa, Artificial Sequence
  synthetic
EIVLTQSPGTLSLSPGDRATLSCRASQSIRNIYLAWYQQKPGQAPRLLIHGASTRATGIPDRFSGSGSGTDFTLTISRLEPEDFAVYYCQQRVSLPYTFGQGTKLEIK

SEQ ID NO: 883 - DNA, 21 bp, Artificial Sequence
  synthetic
cagagtattagaaacatctat

SEQ ID NO: 884 - protein, 7 aa, Artificial Sequence
  synthetic
QSIRNIY

SEQ ID NO: 885 - DNA, 9 bp, Artificial Sequence
  synthetic
ggtgcgtcc

SEQ ID NO: 886 - protein, 3 aa, Artificial Sequence
  synthetic
GAS

SEQ ID NO: 887 - DNA, 27 bp, Artificial Sequence
  synthetic
cagcagcgtgttagtttaccgtacact

SEQ ID NO: 888 - protein, 9 aa, Artificial Sequence
  synthetic
QQRVSLPYT

SEQ ID NO: 889 - DNA, 369 bp, Artificial Sequence
  synthetic
caggtgcagctggtggagtctgggggaggcttggtacagcctggcaggtccctgagactctcctgtgcagcctctggcttcagctttgatgattatgccatgcactgggtccggcaagctccaggacagggcctggagtgggtctcaggtattagttggaatggtggtagcagagactatgcggactctgtgaagggccgattcaccatctccagagacaacgccaggaactccctgtttctgcaaatgaacagtctgtttactgaggacacggccttgtattactgtgcaaaagataagagtggctacggctcctacttctacggtatggacgtctggggccaagggaccacggtcaccgtctcctca

SEQ ID NO: 890 - protein, 123 aa, Artificial Sequence
  synthetic
QVQLVESGGGLVQPGRSLRLSCAASGFSFDDYAMHWVRQAPGQGLEWVSGISWNGGSRDYADSVKGRFTISRDNARNSLFLQMNSLFTEDTALYYCAKDKSGYGSYFYGMDVWGQGTTVTVSS

SEQ ID NO: 891 - DNA, 24 bp, Artificial Sequence
  synthetic
ggcttcagctttgatgattatgcc

SEQ ID NO: 892 - protein, 8 aa, Artificial Sequence
  synthetic
GFSFDDYA

SEQ ID NO: 893 - DNA, 24 bp, Artificial Sequence
  synthetic
attagttggaatggtggtagcaga

SEQ ID NO: 894 - protein, 8 aa, Artificial Sequence
  synthetic
ISWNGGSR

SEQ ID NO: 895 - DNA, 48 bp, Artificial Sequence; identical to SEQ ID NO: 879
  synthetic

SEQ ID NO: 896 - protein, 16 aa, Artificial Sequence
  synthetic
AKDKSGYGSYFYGMDV

SEQ ID NO: 897 - DNA, 324 bp, Artificial Sequence
  synthetic
gaaattgtgttgacgcagtctccaggcattctgtctttgtctccaggggacagagccaccctctcctgcagggccagtcagagtattagaaacatctatttagcctggtaccagcagaaacctggccaggctcccaggctcctcatccatggtgcgtccaccagggccactggcatcccagacaggttcagtggcagtgggtcagggacagacttcactctcaccatcagcagactggagcctgaagattttgcagtttattactgtcagcagcgtgttagttcaccgtacacttttggccaggggaccaagctggagatcaaa

SEQ ID NO: 898 - protein, 108 aa, Artificial Sequence
  synthetic
EIVLTQSPGILSLSPGDRATLSCRASQSIRNIYLAWYQQKPGQAPRLLIHGASTRATGIPDRFSGSGSGTDFTLTISRLEPEDFAVYYCQQRVSSPYTFGQGTKLEIK

SEQ ID NO: 899 - DNA, 21 bp, Artificial Sequence
  synthetic
cagagtattagaaacatctat

SEQ ID NO: 900 - protein, 7 aa, Artificial Sequence
  synthetic
QSIRNIY

SEQ ID NO: 901 - DNA, 9 bp, Artificial Sequence
  synthetic
ggtgcgtcc

SEQ ID NO: 902 - protein, 3 aa, Artificial Sequence
  synthetic
GAS

SEQ ID NO: 903 - DNA, 27 bp, Artificial Sequence
  synthetic
cagcagcgtgttagttcaccgtacact

SEQ ID NO: 904 - protein, 9 aa, Artificial Sequence
  synthetic
QQRVSSPYT

SEQ ID NO: 905 - DNA, 369 bp, Artificial Sequence
  synthetic
gaggtgcagctggtggagtctgggggaggcttggtacagcctggcaggtccctgagactctcctgtgcagcctctggattcacctttgatgattatgccatgcactgggtccggcaagctccaggaaagggcctggagtgggtctcaggtattagttggaatagtggtagcagagactatgcggactctgtgaagggccgattcaccatctccagagacaacgccaggaactccctgtttctgcaaatgaacagtctgagtactgaggacacggccttgtattactgtgcaaaagataagagtggctacggctcctactactacggtatggacgtctggggccaagggaccacggtcaccgtctcctca

SEQ ID NO: 906 - protein, 123 aa, Artificial Sequence
  synthetic
EVQLVESGGGLVQPGRSLRLSCAASGFTFDDYAMHWVRQAPGKGLEWVSGISWNSGSRDYADSVKGRFTISRDNARNSLFLQMNSLSTEDTALYYCAKDKSGYGSYYYGMDVWGQGTTVTVSS

SEQ ID NO: 907 - DNA, 24 bp, Artificial Sequence
  synthetic
ggattcacctttgatgattatgcc

SEQ ID NO: 908 - protein, 8 aa, Artificial Sequence
  synthetic
GFTFDDYA

SEQ ID NO: 909 - DNA, 24 bp, Artificial Sequence
  synthetic
attagttggaatagtggtagcaga

SEQ ID NO: 910 - protein, 8 aa, Artificial Sequence
  synthetic
ISWNSGSR

SEQ ID NO: 911 - DNA, 48 bp, Artificial Sequence
  synthetic
gcaaaagataagagtggctacggctcctactactacggtatggacgtc

SEQ ID NO: 912 - protein, 16 aa, Artificial Sequence
  synthetic
AKDKSGYGSYYYGMDV

SEQ ID NO: 913 - DNA, 324 bp, Artificial Sequence
  synthetic
gaaattgtgttgacgcagtctccaggcaccctgtctttgtctccaggggacagagccaccctctcctgcagggccagtcagagtattagaagcatctacttagcctggtaccagcagaaacctggccaggctcccaggctcctcatccatggtgcgtccaccagggccactggcatcccagacaggttcagtggcagtgggtcagggacagacttcactctcaccatcagcagactggagcctgaagattttgcagtttattactgtcagcagcgtgttagctcaccgtacacttttggccaggggaccaagctggagatcaaa

SEQ ID NO: 914 - protein, 108 aa, Artificial Sequence
  synthetic
EIVLTQSPGTLSLSPGDRATLSCRASQSIRSIYLAWYQQKPGQAPRLLIHGASTRATGIPDRFSGSGSGTDFTLTISRLEPEDFAVYYCQQRVSSPYTFGQGTKLEIK

SEQ ID NO: 915 - DNA, 21 bp, Artificial Sequence
  synthetic
cagagtattagaagcatctac

SEQ ID NO: 916 - protein, 7 aa, Artificial Sequence
  synthetic
QSIRSIY

SEQ ID NO: 917 - DNA, 9 bp, Artificial Sequence
  synthetic
ggtgcgtcc

SEQ ID NO: 918 - protein, 3 aa, Artificial Sequence
  synthetic
GAS

SEQ ID NO: 919 - DNA, 27 bp, Artificial Sequence
  synthetic
cagcagcgtgttagctcaccgtacact

SEQ ID NO: 920 - protein, 9 aa, Artificial Sequence
  synthetic
QQRVSSPYT

SEQ ID NO: 921 - DNA, 369 bp, Artificial Sequence
  synthetic
gaagtgcagctggtggagtctgggggaggcttggtacagcctggcaggtccctgagactctcctgtgtagcctctggattcacctttgctgattttaccatgcactgggtccggcaagcgccagggaagggccttgagtgggtctcaggtattagttggaatagtaatagtatagactatgcggactctgtgaagggccgattcaccatctccagagacaacgccaagaaatccctgtttctgcaaatgtccagtctgagagctgaggacacggccttatattactgtgtcaaagacagaagcggatatagcagattctactacggtatggacgtctggggccaagggaccacggtcaccgtctcctca

SEQ ID NO: 922 - protein, 123 aa, Artificial Sequence
  synthetic
EVQLVESGGGLVQPGRSLRLSCVASGFTFADFTMHWVRQAPGKGLEWVSGISWNSNSIDYADSVKGRFTISRDNAKKSLFLQMSSLRAEDTALYYCVKDRSGYSRFYYGMDVWGQGTTVTVSS

SEQ ID NO: 923 - DNA, 24 bp, Artificial Sequence
  synthetic
ggattcacctttgctgattttacc

SEQ ID NO: 924 - protein, 8 aa, Artificial Sequence
  synthetic
GFTFADFT

SEQ ID NO: 925 - DNA, 24 bp, Artificial Sequence
  synthetic
attagttggaatagtaatagtata

SEQ ID NO: 926 - protein, 8 aa, Artificial Sequence
  synthetic
ISWNSNSI

SEQ ID NO: 927 - DNA, 48 bp, Artificial Sequence
  synthetic
gtcaaagacagaagcggatatagcagattctactacggtatggacgtc

SEQ ID NO: 928 - protein, 16 aa, Artificial Sequence
  synthetic
VKDRSGYSRFYYGMDV

SEQ ID NO: 929 - DNA, 321 bp, Artificial Sequence
  synthetic
gaaattgtgatgacgcagtctccagccaccctgtctgtgtctccaggggaaagagccatcctctcctgcagggccagtcagaatattaatagcaacttggcctggtaccagcagaaacctggccaggctcccaggctcctcatctatggtgcatccaccagggccactggtgtcccagccaggttcagtggcagtgggtctgggacagagttcactctcaccatccgcagcctgcaatctgaagattttgcagtttattactgtcaacaatattataattggccgatcactttcggccacgggacacgactggagattaaa

SEQ ID NO: 930 - protein, 107 aa, Artificial Sequence
  synthetic
EIVMTQSPATLSVSPGERAILSCRASQNINSNLAWYQQKPGQAPRLLIYGASTRATGVPARFSGSGSGTEFTLTIRSLQSEDFAVYYCQQYYNWPITFGHGTRLEIK

SEQ ID NO: 931 - DNA, 18 bp, Artificial Sequence
  synthetic
cagaatattaatagcaac

SEQ ID NO: 932 - protein, 6 aa, Artificial Sequence
  synthetic
QNINSN

SEQ ID NO: 933 - DNA, 9 bp, Artificial Sequence
  synthetic
ggtgcatcc

SEQ ID NO: 934 - protein, 3 aa, Artificial Sequence
  synthetic
GAS

SEQ ID NO: 935 - DNA, 27 bp, Artificial Sequence
  synthetic
caacaatattataattggccgatcact

SEQ ID NO: 936 - protein, 9 aa, Artificial Sequence
  synthetic
QQYYNWPIT

SEQ ID NO: 937 - DNA, 369 bp, Artificial Sequence
  synthetic
gaggtgcagctggtggagtctgggggaggcttggtacagcctggcaggtccctgagactctcctgtgcagcctctggattcacctttgatgattatgccatgcactgggtccggcaagctccaggaaagggcctggagtgggtctcaggtattagttggaatggtggtagtaaagactatgcggactctgtgaagggccgattcaccatctccagagacaacaccaggaactccctgtctctgcaaatgaacagtctgagaattgaagacacggccttatattactgtgcaaaagataagagtggctacggctccttctactacggtttggacgtctggggccaagggaccacggtcaccgtctcctca

SEQ ID NO: 938 - protein, 123 aa, Artificial Sequence
  synthetic
EVQLVESGGGLVQPGRSLRLSCAASGFTFDDYAMHWVRQAPGKGLEWVSGISWNGGSKDYADSVKGRFTISRDNTRNSLSLQMNSLRIEDTALYYCAKDKSGYGSFYYGLDVWGQGTTVTVSS

SEQ ID NO: 939 - DNA, 24 bp, Artificial Sequence
  synthetic
ggattcacctttgatgattatgcc

SEQ ID NO: 940 - protein, 8 aa, Artificial Sequence
  synthetic
GFTFDDYA

SEQ ID NO: 941 - DNA, 24 bp, Artificial Sequence
  synthetic
attagttggaatggtggtagtaaa

SEQ ID NO: 942 - protein, 8 aa, Artificial Sequence
  synthetic
ISWNGGSK

SEQ ID NO: 943 - DNA, 48 bp, Artificial Sequence
  synthetic
gcaaaagataagagtggctacggctccttctactacggtttggacgtc

SEQ ID NO: 944 - protein, 16 aa, Artificial Sequence
  synthetic
AKDKSGYGSFYYGLDV

SEQ ID NO: 945 - DNA, 324 bp, Artificial Sequence
  synthetic
gaaatagtgttgacacagtctccaggcaccctgtctttgtctccaggggacagagccaccctctcctgcagggccagtcagagtattagaagcatctacttagcctggtaccagcagaaacctggccaggctcccaggctcctcatccatggtgcgtccaccagggccactggcatcccagacaggttcagtggcagtgggtcagggacagacttcactctcaccatcagcagactggagcctgaagattttgcagtttattactgtcagcagcgtgttagctcaccgtacacttttggccaggggaccaagctggagatcaaa

SEQ ID NO: 946 - protein, 108 aa, Artificial Sequence; identical to SEQ ID NO: 914
  synthetic

SEQ ID NO: 947 - DNA, 21 bp, Artificial Sequence
  synthetic
cagagtattagaagcatctac

SEQ ID NO: 948 - protein, 7 aa, Artificial Sequence
  synthetic
QSIRSIY

SEQ ID NO: 949 - DNA, 9 bp, Artificial Sequence
  synthetic
ggtgcgtcc

SEQ ID NO: 950 - protein, 3 aa, Artificial Sequence
  synthetic
GAS

SEQ ID NO: 951 - DNA, 27 bp, Artificial Sequence
  synthetic
cagcagcgtgttagctcaccgtacact

SEQ ID NO: 952 - protein, 9 aa, Artificial Sequence
  synthetic
QQRVSSPYT

SEQ ID NO: 953 - DNA, 369 bp, Artificial Sequence
  synthetic
gaggtgcagctggtggagtctgggggaggcttggtacagcctggcaggtccctgagactctcctgtgcagcctctggattcacctttgatgatttcaccatgcactgggtccggcaagctccaggaaagggcctggagtgggtctcagatattagttggaatagtggtagcatagactatgcggactctgtgaagggccgattcaccatttccagagacaatgccaggaactccctgtttctacaaatgagcagtctgagaactgaggacacggcctcgtattactgtataaaagataagagtggctacggctcctacaactacggtctggacgtctggggccaagggaccacggtcaccgtctcctca

SEQ ID NO: 954 - protein, 123 aa, Artificial Sequence
  synthetic
EVQLVESGGGLVQPGRSLRLSCAASGFTFDDFTMHWVRQAPGKGLEWVSDISWNSGSIDYADSVKGRFTISRDNARNSLFLQMSSLRTEDTASYYCIKDKSGYGSYNYGLDVWGQGTTVTVSS

SEQ ID NO: 955 - DNA, 24 bp, Artificial Sequence
  synthetic
ggattcacctttgatgatttcacc

SEQ ID NO: 956 - protein, 8 aa, Artificial Sequence
  synthetic
GFTFDDFT

SEQ ID NO: 957 - DNA, 24 bp, Artificial Sequence
  synthetic
attagttggaatagtggtagcata

SEQ ID NO: 958 - protein, 8 aa, Artificial Sequence
  synthetic
ISWNSGSI

SEQ ID NO: 959 - DNA, 48 bp, Artificial Sequence
  synthetic
ataaaagataagagtggctacggctcctacaactacggtctggacgtc

SEQ ID NO: 960 - protein, 16 aa, Artificial Sequence
  synthetic
IKDKSGYGSYNYGLDV

SEQ ID NO: 961 - DNA, 324 bp, Artificial Sequence
  synthetic
gaaattgtgttgacgcagtctccaggcaccctgtctttgtctccaggggacagagccaccctctcctgcagggccagtcagagtgttagcagcatctacttagcctggtaccagcagaaacctggccaggctcccaggctcctcatccatggtgcgtccaccagggccactggcatcccagacaggttcagtggcagtgggtcggggacagacttcactctcaccatcagcagactggagcctgaagattttgcactttattactgtcaccagcgtgttagttcaccgtacacttttggccaggggaccaagctggagatcaaa

SEQ ID NO: 962 - protein, 108 aa, Artificial Sequence
  synthetic
EIVLTQSPGTLSLSPGDRATLSCRASQSVSSIYLAWYQQKPGQAPRLLIHGASTRATGIPDRFSGSGSGTDFTLTISRLEPEDFALYYCHQRVSSPYTFGQGTKLEIK

SEQ ID NO: 963 - DNA, 21 bp, Artificial Sequence
  synthetic
cagagtgttagcagcatctac

SEQ ID NO: 964 - protein, 7 aa, Artificial Sequence
  synthetic
QSVSSIY

SEQ ID NO: 965 - DNA, 9 bp, Artificial Sequence
  synthetic
ggtgcgtcc

SEQ ID NO: 966 - protein, 3 aa, Artificial Sequence
  synthetic
GAS

SEQ ID NO: 967 - DNA, 27 bp, Artificial Sequence
  synthetic
caccagcgtgttagttcaccgtacact

SEQ ID NO: 968 - protein, 9 aa, Artificial Sequence
  synthetic
HQRVSSPYT

SEQ ID NO: 969 - DNA, 369 bp, Artificial Sequence
  synthetic
gaggtgcagctggtggagtctgggggaggcttggtacagcctggcaggtccctgagactctcctgtgcagcctctggattcacctttgatgattatgccatgcactgggtccggcaagctccaggaaagggcctggagtgggtctcaggtattagttggaatagtggtagtaaagactatgcggactctgtgaagggccgattcaccatctccagagacaacaccaggaactccctgtttctgcaaatgaacagtctgagaactgaagacacggccttatattactgtgcaaaagataagagtggctacggctccttctactacggtatggacgtctggggccaagggaccacggtcaccgtctcctca

SEQ ID NO: 970 - protein, 123 aa, Artificial Sequence
  synthetic
EVQLVESGGGLVQPGRSLRLSCAASGFTFDDYAMHWVRQAPGKGLEWVSGISWNSGSKDYADSVKGRFTISRDNTRNSLFLQMNSLRTEDTALYYCAKDKSGYGSFYYGMDVWGQGTTVTVSS

SEQ ID NO: 971 - DNA, 24 bp, Artificial Sequence
  synthetic
ggattcacctttgatgattatgcc

SEQ ID NO: 972 - protein, 8 aa, Artificial Sequence
  synthetic
GFTFDDYA

SEQ ID NO: 973 - DNA, 24 bp, Artificial Sequence
  synthetic
attagttggaatagtggtagtaaa

SEQ ID NO: 974 - protein, 8 aa, Artificial Sequence
  synthetic
ISWNSGSK

SEQ ID NO: 975 - DNA, 48 bp, Artificial Sequence; identical to SEQ ID NO: 863
  synthetic

SEQ ID NO: 976 - protein, 16 aa, Artificial Sequence
  synthetic
AKDKSGYGSFYYGMDV

SEQ ID NO: 977 - DNA, 318 bp, Artificial Sequence
  synthetic
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattctccgttcggccaagggaccaaggtggaaatcaaa

SEQ ID NO: 978 - protein, 106 aa, Artificial Sequence
  synthetic
DIQMTQSPSTLSASVGDRVTITCRASQSISSWLAWYQQKPGKAPKLLIYKASSLESGVPSRFSGSGSGTEFTLTISSLQPDDFATYYCQQYNSYSPFGQGTKVEIK

SEQ ID NO: 979 - DNA, 18 bp, Artificial Sequence
  synthetic
cagagtattagtagctgg

SEQ ID NO: 980 - protein, 6 aa, Artificial Sequence
  synthetic
QSISSW

SEQ ID NO: 981 - DNA, 9 bp, Artificial Sequence
  synthetic
aaggcgtct

SEQ ID NO: 982 - protein, 3 aa, Artificial Sequence
  synthetic
KAS

SEQ ID NO: 983 - DNA, 24 bp, Artificial Sequence
  synthetic
caacagtataatagttattctccg

SEQ ID NO: 984 - protein, 8 aa, Artificial Sequence
  synthetic
QQYNSYSP

SEQ ID NO: 985 - DNA, 372 bp, Artificial Sequence
  synthetic
caggtgcaactggtggagtctgggggaggcgtggtccagcctgggaggtccctgagactctcctgtgcagcctctggactcaccttcagtacctatgtcatgcactgggtccgccaggctccaggcaaggggctggcgtgggtggcagttatagcaaatgatggaagtaataaatattatgcagactccgtgaagggccgattcaccatctccagagacaactccaagaacacgctgtatctgcaaatgaatagcctgagacctgaggacacggctgtgtatttttgtgcgaaagaggggggtaccagtgggtcctactattactatggaatggacgtctggggtcaagggactacggtcaccgtctcctca

SEQ ID NO: 986 - protein, 124 aa, Artificial Sequence
  synthetic
QVQLVESGGGVVQPGRSLRLSCAASGLTFSTYVMHWVRQAPGKGLAWVAVIANDGSNKYYADSVKGRFTISRDNSKNTLYLQMNSLRPEDTAVYFCAKEGGTSGSYYYYGMDVWGQGTTVTVSS

SEQ ID NO: 987 - DNA, 24 bp, Artificial Sequence
  synthetic
ggactcaccttcagtacctatgtc

SEQ ID NO: 988 - protein, 8 aa, Artificial Sequence
  synthetic
GLTFSTYV

SEQ ID NO: 989 - DNA, 24 bp, Artificial Sequence
  synthetic
atagcaaatgatggaagtaataaa

SEQ ID NO: 990 - protein, 8 aa, Artificial Sequence
  synthetic
IANDGSNK

SEQ ID NO: 991 - DNA, 51 bp, Artificial Sequence
  synthetic
gcgaaagaggggggtaccagtgggtcctactattactatggaatggacgtc

SEQ ID NO: 992 - protein, 17 aa, Artificial Sequence
  synthetic
AKEGGTSGSYYYYGMDV

SEQ ID NO: 993 - DNA, 342 bp, Artificial Sequence
  synthetic
gacatccagatgacccagtctccagactccctggctgtgtctctgggcgagagggccaccatcaactgcaagtccagccagagtcttttattcaactccatcaataagaactacttagcttggtaccagcagaaaccaggacagcctcctaagcttctcctttactgggcatctacccgggaatccgggatccctgaccgattcagtggcagcgggtctgggacagatttcactctcaccatcaccagcctgcaggctgaagatgtggcactttattactgtcagcaatattatagtattccgtggacgttcggccaagggaccaaggtggaaatcaaacga

SEQ ID NO: 994 - protein, 114 aa, Artificial Sequence
  synthetic
DIQMTQSPDSLAVSLGERATINCKSSQSLLFNSINKNYLAWYQQKPGQPPKLLLYWASTRESGIPDRFSGSGSGTDFTLTITSLQAEDVALYYCQQYYSIPWTFGQGTKVEIKR

SEQ ID NO: 995 - DNA, 36 bp, Artificial Sequence
  synthetic
cagagtcttttattcaactccatcaataagaactac

SEQ ID NO: 996 - protein, 12 aa, Artificial Sequence
  synthetic
QSLLFNSINKNY

SEQ ID NO: 997 - DNA, 9 bp, Artificial Sequence
  synthetic
tgggcatct

SEQ ID NO: 998 - protein, 3 aa, Artificial Sequence
  synthetic
WAS

SEQ ID NO: 999 - DNA, 27 bp, Artificial Sequence
  synthetic
cagcaatattatagtattccgtggacg

SEQ ID NO: 1000 - protein, 9 aa, Artificial Sequence
  synthetic
QQYYSIPWT

SEQ ID NO: 1001 - DNA, 354 bp, Artificial Sequence
  synthetic
caggtgcagctggtggagtctggggctgaagtgaagaagcctggggcctcagtgaaggtctcctgcaagacttctggatacaccttcaccggctactatatgcactggatacgacaggcccctggacaagggcttgagtggatgggatggatcaaccctaaaagtggtggcacaaattatgcacagaagtttcagggcagggtcaccatgaccagggacacgtccatcagcacagcctacatggaactgagcaggctgagatccgacgacatggccgtgtattattgtgcgagaatgggggacggtgcagtgtttgacttctggggccagggaaccctggtcaccgtctcctca

SEQ ID NO: 1002 - protein, 118 aa, Artificial Sequence
  synthetic
QVQLVESGAEVKKPGASVKVSCKTSGYTFTGYYMHWIRQAPGQGLEWMGWINPKSGGTNYAQKFQGRVTMTRDTSISTAYMELSRLRSDDMAVYYCARMGDGAVFDFWGQGTLVTVSS

SEQ ID NO: 1003 - DNA, 24 bp, Artificial Sequence
  synthetic
ggatacaccttcaccggctactat

SEQ ID NO: 1004 - protein, 8 aa, Artificial Sequence
  synthetic
GYTFTGYY

SEQ ID NO: 1005 - DNA, 24 bp, Artificial Sequence
  synthetic
atcaaccctaaaagtggtggcaca

SEQ ID NO: 1006 - protein, 8 aa, Artificial Sequence
  synthetic
INPKSGGT

SEQ ID NO: 1007 - DNA, 33 bp, Artificial Sequence
  synthetic
gcgagaatgggggacggtgcagtgtttgacttc

SEQ ID NO: 1008 - protein, 11 aa, Artificial Sequence
  synthetic
ARMGDGAVFDF

SEQ ID NO: 1009 - DNA, 324 bp, Artificial Sequence
  synthetic
gccatccagatgacccagtctccatcctccctgtctgcatctgtaggagacagagtcaccatcacttgccgggcaagtcagaggattagcagctttttaaattggtatcagcagaaaccagggaaagcccctaagctcctgatctatactgcatccaatttacaaaatggggtcccatcaaggttcagtggcagtggatctgggacagatttcactctcactatcagcagtctgcaacctgaagattttgctacttactactgtcaacagagttacaggaccccgctcactttcggcggagggaccaaggtggaaatcaaacga

SEQ ID NO: 1010 - protein, 108 aa, Artificial Sequence
  synthetic
AIQMTQSPSSLSASVGDRVTITCRASQRISSFLNWYQQKPGKAPKLLIYTASNLQNGVPSRFSGSGSGTDFTLTISSLQPEDFATYYCQQSYRTPLTFGGGTKVEIKR

SEQ ID NO: 1011 - DNA, 18 bp, Artificial Sequence
  synthetic
cagaggattagcagcttt

SEQ ID NO: 1012 - protein, 6 aa, Artificial Sequence
  synthetic
QRISSF

SEQ ID NO: 1013 - DNA, 9 bp, Artificial Sequence
  synthetic
actgcatcc

SEQ ID NO: 1014 - protein, 3 aa, Artificial Sequence
  synthetic
TAS

SEQ ID NO: 1015 - DNA, 27 bp, Artificial Sequence
  synthetic
caacagagttacaggaccccgctcact

SEQ ID NO: 1016 - protein, 9 aa, Artificial Sequence
  synthetic
QQSYRTPLT

SEQ ID NO: 1017 - DNA, 369 bp, Artificial Sequence
  synthetic
gaggtgcagctggtggagtctgggggaggcttggtacagcctggcaggtccctgagactctcctgtgcagcctctggattcacctttgatgattataccatgcactgggtccggcaagctccagggaagggcctggagtgggtctcaggtattagttggaacagtggtagcataggctatgcggactctgtgaagggccgattcaccatttccagagacaacgccaagaactccctgtatttgcaaatgaacagtctgagagctgaggacacggccttgttttactgtgcaaaagatcaaagtggttacggccactactactacggtatggacgtctggggccaagggaccacggtcaccgtctcctca

SEQ ID NO: 1018 - protein, 123 aa, Artificial Sequence
  synthetic
EVQLVESGGGLVQPGRSLRLSCAASGFTFDDYTMHWVRQAPGKGLEWVSGISWNSGSIGYADSVKGRFTISRDNAKNSLYLQMNSLRAEDTALFYCAKDQSGYGHYYYGMDVWGQGTTVTVSS

SEQ ID NO: 1019 - DNA, 24 bp, Artificial Sequence
  synthetic
ggattcacctttgatgattatacc

SEQ ID NO: 1020 - protein, 8 aa, Artificial Sequence
  synthetic
GFTFDDYT

SEQ ID NO: 1021 - DNA, 24 bp, Artificial Sequence
  synthetic
attagttggaacagtggtagcata

SEQ ID NO: 1022 - protein, 8 aa, Artificial Sequence
  synthetic
ISWNSGSI

SEQ ID NO: 1023 - DNA, 48 bp, Artificial Sequence
  synthetic
gcaaaagatcaaagtggttacggccactactactacggtatggacgtc

SEQ ID NO: 1024 - protein, 16 aa, Artificial Sequence
  synthetic
AKDQSGYGHYYYGMDV

SEQ ID NO: 1025 - DNA, 321 bp, Artificial Sequence
  synthetic
gaaatagtgatgacgcagtctccagccaccctgtctgtgtctccaggggaaagagccaccctctcctgtagggccagtcagagtgttagcagcaacttagcctggtaccagcagaaacctggccaggctcccaggctcctcatctatggtgcatccaccagggccactgatatcccagccaggttcagtggcagtgggtctgggacagagttcactctcaccatcagcagcctgcagtctgaagattttgcagtttatcactgtcagcagtataataactggccgctcactttcggcggagggaccaaggtggagatcaaa

SEQ ID NO: 1026 - protein, 107 aa, Artificial Sequence
  synthetic
EIVMTQSPATLSVSPGERATLSCRASQSVSSNLAWYQQKPGQAPRLLIYGASTRATDIPARFSGSGSGTEFTLTISSLQSEDFAVYHCQQYNNWPLTFGGGTKVEIK

SEQ ID NO: 1027 - DNA, 18 bp, Artificial Sequence
  synthetic
cagagtgttagcagcaac

SEQ ID NO: 1028 - protein, 6 aa, Artificial Sequence
  synthetic
QSVSSN

SEQ ID NO: 1029 - DNA, 9 bp, Artificial Sequence
  synthetic
ggtgcatcc

SEQ ID NO: 1030 - protein, 3 aa, Artificial Sequence
  synthetic
GAS

SEQ ID NO: 1031 - DNA, 27 bp, Artificial Sequence
  synthetic
cagcagtataataactggccgctcact

SEQ ID NO: 1032 - protein, 9 aa, Artificial Sequence
  synthetic
QQYNNWPLT

SEQ ID NO: 1033 - DNA, 387 bp, Artificial Sequence
  synthetic
gaggtgcagctggtggagtctgggggaggcgtggtccagcctgggaggtccctgagactctcctgtgcagcctctggattcaccttcagttactatggcatgcactgggtccgccaggctccaggcaaggggctggagtgggtggcagttatatcatttgatggaaagaataaatattatgcagactccgtgatgggccgattcaccatctccagagacaattccaagaatacactgtatctgcaaatgaacagcctgagagctgaggactcggctgtgtttttctgtgcgaggtcttacgacattttgactggttatggagccggttacagctaccactacggtatggacgtctggggccaagggaccacggtcaccgtctcctca

SEQ ID NO: 1034 - protein, 129 aa, Artificial Sequence
  synthetic
EVQLVESGGGVVQPGRSLRLSCAASGFTFSYYGMHWVRQAPGKGLEWVAVISFDGKNKYYADSVMGRFTISRDNSKNTLYLQMNSLRAEDSAVFFCARSYDILTGYGAGYSYHYGMDVWGQGTTVTVSS

SEQ ID NO: 1035 - DNA, 24 bp, Artificial Sequence
  synthetic
ggattcaccttcagttactatggc

SEQ ID NO: 1036 - protein, 8 aa, Artificial Sequence
  synthetic
GFTFSYYG

SEQ ID NO: 1037 - DNA, 24 bp, Artificial Sequence
  synthetic
atatcatttgatggaaagaataaa

SEQ ID NO: 1038 - protein, 8 aa, Artificial Sequence
  synthetic
ISFDGKNK

SEQ ID NO: 1039 - DNA, 66 bp, Artificial Sequence
  synthetic
gcgaggtcttacgacattttgactggttatggagccggttacagctaccactacggtatggacgtc

SEQ ID NO: 1040 - protein, 22 aa, Artificial Sequence
  synthetic
ARSYDILTGYGAGYSYHYGMDV

SEQ ID NO: 1041 - DNA, 324 bp, Artificial Sequence
  synthetic
gccatccagatgacccagtctccatcctccctgtctgcatctgtaggagacagagtcaccatcacttgccgggcaagtcagaggattagcagctttttaaattggtatcagcagaaaccagggaaagcccctaagctcctaatctatactgcatccaatttacaaaatggggtcccatcaaggttcagtggcagtggatctgggacagatttcactctcaccatcagcagtctgcaacctgaagattttgcaacttactactgtcaacagagttacaggaccccgctcactttcggcggagggaccaaggtggagatcaaacga

SEQ ID NO: 1042 - protein, 108 aa, Artificial Sequence; identical to SEQ ID NO: 1010
  synthetic

SEQ ID NO: 1043 - DNA, 18 bp, Artificial Sequence
  synthetic
cagaggattagcagcttt

SEQ ID NO: 1044 - protein, 6 aa, Artificial Sequence
  synthetic
QRISSF

SEQ ID NO: 1045 - DNA, 9 bp, Artificial Sequence
  synthetic
actgcatcc

SEQ ID NO: 1046 - protein, 3 aa, Artificial Sequence
  synthetic
TAS

SEQ ID NO: 1047 - DNA, 27 bp, Artificial Sequence
  synthetic
caacagagttacaggaccccgctcact

SEQ ID NO: 1048 - protein, 9 aa, Artificial Sequence
  synthetic
QQSYRTPLT

SEQ ID NO: 1049 - DNA, 354 bp, Artificial Sequence
  synthetic
caggtgcagctggtggagtctggggctgaagtgaagaagcctggggcctcagtgaaggtctcctgcaagacttctggatacaccctctccggctattatatgcactggatgcgacaggcccctggacaagggcttgagtggatgggatggattaaccctaaaagtggtgtcacaaattatgcacagaagtttcaggacagagtcgccatgaccagggacacgtccatcagcacagcctacatggaactgagcaggctgagatctgacgacacggccgtgtattactgtgcgagaatgggggacggtgcagtgtttgacttctgggcccagggaaccctggtcaccgtctcctca

SEQ ID NO: 1050 - protein, 118 aa, Artificial Sequence
  synthetic
QVQLVESGAEVKKPGASVKVSCKTSGYTLSGYYMHWMRQAPGQGLEWMGWINPKSGVTNYAQKFQDRVAMTRDTSISTAYMELSRLRSDDTAVYYCARMGDGAVFDFWAQGTLVTVSS

SEQ ID NO: 1051 - DNA, 24 bp, Artificial Sequence
  synthetic
ggatacaccctctccggctattat

SEQ ID NO: 1052 - protein, 8 aa, Artificial Sequence
  synthetic
GYTLSGYY

SEQ ID NO: 1053 - DNA, 24 bp, Artificial Sequence
  synthetic
attaaccctaaaagtggtgtcaca

SEQ ID NO: 1054 - protein, 8 aa, Artificial Sequence
  synthetic
INPKSGVT

SEQ ID NO: 1055 - DNA, 33 bp, Artificial Sequence; identical to SEQ ID NO: 1007
  synthetic

SEQ ID NO: 1056 - protein, 11 aa, Artificial Sequence
  synthetic
ARMGDGAVFDF

SEQ ID NO: 1057 - DNA, 324 bp, Artificial Sequence
  synthetic
gacatccagttgacccagtctccatcctccctgtctgcatctgtaggagacagagtcaccatcacttgccgggcaagtcagaggattagcagctttttaaattggtatcagcagaaaccagggaaagcccctaagctcctaatctatactgcatccaatttacaaaatggggtcccatcaaggttcagtggcagtggatctgggacagatttcactctcaccatcagcagtctgcaacctgaagattttgcaacttactactgtcaacagagttacaggaccccgctcactttcggcggagggaccaagctggagatcaaacga

SEQ ID NO: 1058 - protein, 108 aa, Artificial Sequence
  synthetic
DIQLTQSPSSLSASVGDRVTITCRASQRISSFLNWYQQKPGKAPKLLIYTASNLQNGVPSRFSGSGSGTDFTLTISSLQPEDFATYYCQQSYRTPLTFGGGTKLEIKR

SEQ ID NO: 1059 - DNA, 18 bp, Artificial Sequence
  synthetic
cagaggattagcagcttt

SEQ ID NO: 1060 - protein, 6 aa, Artificial Sequence
  synthetic
QRISSF

SEQ ID NO: 1061 - DNA, 9 bp, Artificial Sequence
  synthetic
actgcatcc

SEQ ID NO: 1062 - protein, 3 aa, Artificial Sequence
  synthetic
TAS

SEQ ID NO: 1063 - DNA, 27 bp, Artificial Sequence
  synthetic
caacagagttacaggaccccgctcact

SEQ ID NO: 1064 - protein, 9 aa, Artificial Sequence
  synthetic
QQSYRTPLT

SEQ ID NO: 1065 - DNA, 372 bp, Artificial Sequence
  synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtgtcaactatatcatttgatggaagtaacaaatactatgcagactccgtgaagggccgattcaccatctccagagacaattccaagaacacgctgtatctgcaaatgaacagcctgagacctgaggacacggctgtgtattactgtgcgaaaggggggggtaccagtgggtcctacttttactacggtatggacgtctggggccaagggaccacggtcaccgtctcctca

SEQ ID NO: 1066 - protein, 124 aa, Artificial Sequence
  synthetic
QVQLVESGGGVVQPGRSLRLSCAASGFTFSSYGMHWVRQAPGKGLEWVSTISFDGSNKYYADSVKGRFTISRDNSKNTLYLQMNSLRPEDTAVYYCAKGGGTSGSYFYYGMDVWGQGTTVTVSS

SEQ ID NO: 1067 - DNA, 24 bp, Artificial Sequence
  synthetic
ggattcaccttcagtagctatggc

SEQ ID NO: 1068 - protein, 8 aa, Artificial Sequence
  synthetic
GFTFSSYG

SEQ ID NO: 1069 - DNA, 24 bp, Artificial Sequence
  synthetic
atatcatttgatggaagtaacaaa

SEQ ID NO: 1070 - protein, 8 aa, Artificial Sequence
  synthetic
ISFDGSNK

SEQ ID NO: 1071 - DNA, 51 bp, Artificial Sequence
  synthetic
gcgaaaggggggggtaccagtgggtcctacttttactacggtatggacgtc

SEQ ID NO: 1072 - protein, 17 aa, Artificial Sequence
  synthetic
AKGGGTSGSYFYYGMDV

SEQ ID NO: 1073 - DNA, 324 bp, Artificial Sequence
  synthetic
gccatccagatgacccagtctccatcctccctgtctgcatctgtaggagacagagtcaccatcacttgccgggcaagtcagaggattagcagctttttaaattggtatcagcagaaaccagggaaagcccctaagctcctaatctatactgcatccaatttacaaaatggggtcccatcaaggttcagtggcagtggatctgggacagatttcactctcaccatcagcagtctgcaacctgaagattttgcaacttactactgtcaacagagttacaggaccccgctcactttcggcggagggaccaagctggagatcaaacga

SEQ ID NO: 1074 - protein, 108 aa, Artificial Sequence
  synthetic
AIQMTQSPSSLSASVGDRVTITCRASQRISSFLNWYQQKPGKAPKLLIYTASNLQNGVPSRFSGSGSGTDFTLTISSLQPEDFATYYCQQSYRTPLTFGGGTKLEIKR

SEQ ID NO: 1075 - DNA, 18 bp, Artificial Sequence
  synthetic
cagaggattagcagcttt

SEQ ID NO: 1076 - protein, 6 aa, Artificial Sequence
  synthetic
QRISSF

SEQ ID NO: 1077 - DNA, 9 bp, Artificial Sequence
  synthetic
actgcatcc

SEQ ID NO: 1078 - protein, 3 aa, Artificial Sequence
  synthetic
TAS

SEQ ID NO: 1079 - DNA, 27 bp, Artificial Sequence
  synthetic
caacagagttacaggaccccgctcact

SEQ ID NO: 1080 - protein, 9 aa, Artificial Sequence
  synthetic
QQSYRTPLT

SEQ ID NO: 1081 - DNA, 354 bp, Artificial Sequence
  synthetic
caggttcagctggtgcagtctgggactgaggtgaagaagcctggggcctcaatgaaggtctcctgcaaggcttctggatacaccttcaccggctactatattcactgggtgcgacaggcccctggacaagggcttgagtggatgggatggatcaaccctaacagtgatgtcacaaagtatgcacagaagtttcagggcagggtcaccttgaccagggacacgtccatcagtgcagcctatattgacctgagcaggctgagatctgacgacacggccatttattactgtgcgagaatgggggacggtgcagtgtttgactactggggccagggaaccctggtcaccgtctcctca

SEQ ID NO: 1082 - protein, 118 aa, Artificial Sequence
  synthetic
QVQLVQSGTEVKKPGASMKVSCKASGYTFTGYYIHWVRQAPGQGLEWMGWINPNSDVTKYAQKFQGRVTLTRDTSISAAYIDLSRLRSDDTAIYYCARMGDGAVFDYWGQGTLVTVSS

SEQ ID NO: 1083 - DNA, 24 bp, Artificial Sequence
  synthetic
ggatacaccttcaccggctactat

SEQ ID NO: 1084 - protein, 8 aa, Artificial Sequence
  synthetic
GYTFTGYY

SEQ ID NO: 1085 - DNA, 24 bp, Artificial Sequence
  synthetic
atcaaccctaacagtgatgtcaca

SEQ ID NO: 1086 - protein, 8 aa, Artificial Sequence
  synthetic
INPNSDVT

SEQ ID NO: 1087 - DNA, 33 bp, Artificial Sequence
  synthetic
gcgagaatgggggacggtgcagtgtttgactac

SEQ ID NO: 1088 - protein, 11 aa, Artificial Sequence
  synthetic
ARMGDGAVFDY

SEQ ID NO: 1089 - DNA, 324 bp, Artificial Sequence
  synthetic
gacatccagttgacccagtctccatcctccctgtctgcatctgtaggagacagagtcaccatcacttgccgggcaagtcaacgcattagcagctatttaaattggtatcaacagaaaccagggaaagcccctaaggtgctgatctctgttgcatccagtttacaaagtggggtcccatcaaggttcagtggcagtggatttgggacagatttcactctcaccatcagcagtctgcaacctgaggattctgcatcttactactgtcaacagagttacaataccccgctcactttcggcggcgggaccaagctggagatcaaacga

SEQ ID NO: 1090 - protein, 108 aa, Artificial Sequence
  synthetic
DIQLTQSPSSLSASVGDRVTITCRASQRISSYLNWYQQKPGKAPKVLISVASSLQSGVPSRFSGSGFGTDFTLTISSLQPEDSASYYCQQSYNTPLTFGGGTKLEIKR

SEQ ID NO: 1091 - DNA, 18 bp, Artificial Sequence
  synthetic
caacgcattagcagctat

SEQ ID NO: 1092 - protein, 6 aa, Artificial Sequence
  synthetic
QRISSY

SEQ ID NO: 1093 - DNA, 9 bp, Artificial Sequence
  synthetic
gttgcatcc

SEQ ID NO: 1094 - protein, 3 aa, Artificial Sequence
  synthetic
VAS

SEQ ID NO: 1095 - DNA, 27 bp, Artificial Sequence
  synthetic
caacagagttacaataccccgctcact

SEQ ID NO: 1096 - protein, 9 aa, Artificial Sequence
  synthetic
QQSYNTPLT

SEQ ID NO: 1097 - DNA, 354 bp, Artificial Sequence
  synthetic
gaggtgcagctggtggagtctggggctgaagtgaagaagcctggggcctcagtgaaggtctcctgcaagacttctggatacagtttcattggctattatatacactggatgcgacaggcccctggacaagggcttgaatggatgggatggatcaaccctaagagtggtgtcacaaattatgcacagaggtttcagggcagggtcaccatgaccagggacacgtccatcagtactgcctacatggaactgagcaggctgaaatctgacgacacggccgtgtatttctgtgcgagaatgggggacggtgcagtgtttgacttctggggccagggaaccctggtcaccgtctcctca

SEQ ID NO: 1098 - protein, 118 aa, Artificial Sequence
  synthetic
EVQLVESGAEVKKPGASVKVSCKTSGYSFIGYYIHWMRQAPGQGLEWMGWINPKSGVTNYAQRFQGRVTMTRDTSISTAYMELSRLKSDDTAVYFCARMGDGAVFDFWGQGTLVTVSS

SEQ ID NO: 1099 - DNA, 24 bp, Artificial Sequence
  synthetic
ggatacagtttcattggctattat

SEQ ID NO: 1100 - protein, 8 aa, Artificial Sequence
  synthetic
GYSFIGYY

SEQ ID NO: 1101 - DNA, 24 bp, Artificial Sequence
  synthetic
atcaaccctaagagtggtgtcaca

SEQ ID NO: 1102 - protein, 8 aa, Artificial Sequence
  synthetic
INPKSGVT

SEQ ID NO: 1103 - DNA, 33 bp, Artificial Sequence; identical to SEQ ID NO: 1007
  synthetic

SEQ ID NO: 1104 - protein, 11 aa, Artificial Sequence
  synthetic
ARMGDGAVFDF

SEQ ID NO: 1105 - DNA, 324 bp, Artificial Sequence
  synthetic
gacatccagttgacccagtctccatcctccctgtctgcatctgtaggagacagagtcaccatcacttgccgggcaagtcagaggattagcagctttttaaattggtatcagcagaaaccagggaaagtccctaagctcctgatctatactgcatccaatttacaaaatggggtcccatcaaggttcagtggcactggatctgggacagatttcactctcaccatcagcagtctgcaacctgaagattttgcaacttactactgtcaacagagttacaggaccccgctcactttcggcggagggaccaaagtggatatcaaacga

SEQ ID NO: 1106 - protein, 108 aa, Artificial Sequence
  synthetic
DIQLTQSPSSLSASVGDRVTITCRASQRISSFLNWYQQKPGKVPKLLIYTASNLQNGVPSRFSGTGSGTDFTLTISSLQPEDFATYYCQQSYRTPLTFGGGTKVDIKR

SEQ ID NO: 1107 - DNA, 18 bp, Artificial Sequence
  synthetic
cagaggattagcagcttt

SEQ ID NO: 1108 - protein, 6 aa, Artificial Sequence
  synthetic
QRISSF

SEQ ID NO: 1109 - DNA, 9 bp, Artificial Sequence
  synthetic
actgcatcc

SEQ ID NO: 1110 - protein, 3 aa, Artificial Sequence
  synthetic
TAS

SEQ ID NO: 1111 - DNA, 27 bp, Artificial Sequence
  synthetic
caacagagttacaggaccccgctcact

SEQ ID NO: 1112 - protein, 9 aa, Artificial Sequence
  synthetic
QQSYRTPLT

SEQ ID NO: 1113 - DNA, 354 bp, Artificial Sequence
  synthetic
gaggtgcagctggtggagtctggggctgaagtgaagaagcctggggcctcagtgaaggtctcctgcaagacttctggatacaccttcaccggctactatatgcactggatacgacaggcccctggacaagggcttgagtggatgggatggatcaaccctaaaagtggtggcacaaattatgcacagaagtttcagggcagggtcaccatgaccagggacacgtccatcagcacagcctacatggaactgagcaggctgagatccgacgacatggccgtgtattattgtgcgagaatgggggacggtgcagtgtttgacttctggggccagggaaccctggtcaccgtctcctca

SEQ ID NO: 1114 - protein, 118 aa, Artificial Sequence
  synthetic
EVQLVESGAEVKKPGASVKVSCKTSGYTFTGYYMHWIRQAPGQGLEWMGWINPKSGGTNYAQKFQGRVTMTRDTSISTAYMELSRLRSDDMAVYYCARMGDGAVFDFWGQGTLVTVSS

SEQ ID NO: 1115 - DNA, 24 bp, Artificial Sequence
  synthetic
ggatacaccttcaccggctactat

SEQ ID NO: 1116 - protein, 8 aa, Artificial Sequence
  synthetic
GYTFTGYY

SEQ ID NO: 1117 - DNA, 24 bp, Artificial Sequence
  synthetic
atcaaccctaaaagtggtggcaca

SEQ ID NO: 1118 - protein, 8 aa, Artificial Sequence
  synthetic
INPKSGGT

SEQ ID NO: 1119 - DNA, 33 bp, Artificial Sequence; identical to SEQ ID NO: 1007
  synthetic

SEQ ID NO: 1120 - protein, 11 aa, Artificial Sequence
  synthetic
ARMGDGAVFDF

SEQ ID NO: 1121 - DNA, 327 bp, Artificial Sequence
  synthetic
gacatcgtgatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgctcactttcggcggagggaccaaagtggatatcaaacga

SEQ ID NO: 1122 - protein, 109 aa, Artificial Sequence
  synthetic
DIVMTQSPSSLSASVGDRVTITCRASQSISSYLNWYQQKPGKAPKLLIYAASSLQSGVPSRFSGSGSGTDFTLTISSLQPEDFATYYCQQSYSTPPLTFGGGTKVDIKR

SEQ ID NO: 1123 - DNA, 18 bp, Artificial Sequence
  synthetic
cagagcattagcagctat

SEQ ID NO: 1124 - protein, 6 aa, Artificial Sequence
  synthetic
QSISSY

SEQ ID NO: 1125 - DNA, 9 bp, Artificial Sequence
  synthetic
gctgcatcc

SEQ ID NO: 1126 - protein, 3 aa, Artificial Sequence
  synthetic
AAS

SEQ ID NO: 1127 - DNA, 30 bp, Artificial Sequence
  synthetic
caacagagttacagtacccctccgctcact

SEQ ID NO: 1128 - protein, 10 aa, Artificial Sequence
  synthetic
QQSYSTPPLT

SEQ ID NO: 1129 - DNA, 354 bp, Artificial Sequence
  synthetic
caggttcagctggtgcagtctgggactgaggtgaagaagcctggggcctcagtgaaggtctcctgcaaggcttctggatacaccttcaccggctactatatgcactgggtgcgacaggcccctggacaagggcttgagtggatgggatggatcaaccctaacagtgatgtcacaaactatgcacagaagtttcagggcagggtcaccttgaccagggacacgtccatcagtacagcctacattgacctgagcaggctgagatctgacgacacggccatttattactgtgcgagaatgggggacggtgcagtgtttgactactggggccagggaaccctggtcaccgtctcctca

SEQ ID NO: 1130 - protein, 118 aa, Artificial Sequence
  synthetic
QVQLVQSGTEVKKPGASVKVSCKASGYTFTGYYMHWVRQAPGQGLEWMGWINPNSDVTNYAQKFQGRVTLTRDTSISTAYIDLSRLRSDDTAIYYCARMGDGAVFDYWGQGTLVTVSS

SEQ ID NO: 1131 - DNA, 24 bp, Artificial Sequence
  synthetic
ggatacaccttcaccggctactat

SEQ ID NO: 1132 - protein, 8 aa, Artificial Sequence
  synthetic
GYTFTGYY

SEQ ID NO: 1133 - DNA, 24 bp, Artificial Sequence
  synthetic
atcaaccctaacagtgatgtcaca

SEQ ID NO: 1134 - protein, 8 aa, Artificial Sequence
  synthetic
INPNSDVT

SEQ ID NO: 1135 - DNA, 33 bp, Artificial Sequence; identical to SEQ ID NO: 1087
  synthetic

SEQ ID NO: 1136 - protein, 11 aa, Artificial Sequence
  synthetic
ARMGDGAVFDY

SEQ ID NO: 1137 - DNA, 324 bp, Artificial Sequence
  synthetic
gacatccagatgacccagtctccatcctccctgtctgcatctgtaggagacagagtcaccatcacttgccgggcaagtcagcgcattagcagctatttaaattggtatcagcagaaaccagggaaagcccctaaggtgctgatctctgttgcatccagtttgcaaagtggggtcccatcaaggttcagtggcagtggatctgggacagatttcactctcaccattagtagtctgcaacctgaggattttgcatcttactactgtcaacagagttacaataccccgctcactttcggcggagggaccaaggtggagatcaaacga

SEQ ID NO: 1138 - protein, 108 aa, Artificial Sequence
  synthetic
DIQMTQSPSSLSASVGDRVTITCRASQRISSYLNWYQQKPGKAPKVLISVASSLQSGVPSRFSGSGSGTDFTLTISSLQPEDFASYYCQQSYNTPLTFGGGTKVEIKR

SEQ ID NO: 1139 - DNA, 18 bp, Artificial Sequence
  synthetic
cagcgcattagcagctat

SEQ ID NO: 1140 - protein, 6 aa, Artificial Sequence
  synthetic
QRISSY

SEQ ID NO: 1141 - DNA, 9 bp, Artificial Sequence
  synthetic
gttgcatcc

SEQ ID NO: 1142 - protein, 3 aa, Artificial Sequence
  synthetic
VAS

SEQ ID NO: 1143 - DNA, 27 bp, Artificial Sequence
  synthetic
caacagagttacaataccccgctcact

SEQ ID NO: 1144 - protein, 9 aa, Artificial Sequence
  synthetic
QQSYNTPLT

SEQ ID NO: 1145 - DNA, 381 bp, Artificial Sequence
  synthetic
caggtgcagctggtgcagtctgggggaggcttggtcaagcctggggggtccctgagactctcctgtgcagcctctggattcaccttcagtagctatgacatgagctgggtccgccaggctccagggaaggggctggagtgggtttcatacattagtagtagtggtaataccatacattacgcagactctgtgaagggccgattcaccatctccagagacaattccaagaactcactttatctgcaaatgaacagcctgagagccgaggacacggccgtgtattactgtgcgaaagccggtcccgctacggtgacacggaggtactactactactacggtttggacgtctggggccaagggaccacggtcaccgtctcctca

SEQ ID NO: 1146 - protein, 127 aa, Artificial Sequence
  synthetic
QVQLVQSGGGLVKPGGSLRLSCAASGFTFSSYDMSWVRQAPGKGLEWVSYISSSGNTIHYADSVKGRFTISRDNSKNSLYLQMNSLRAEDTAVYYCAKAGPATVTRRYYYYYGLDVWGQGTTVTVSS

SEQ ID NO: 1147 - DNA, 24 bp, Artificial Sequence
  synthetic
ggattcaccttcagtagctatgac

SEQ ID NO: 1148 - protein, 8 aa, Artificial Sequence
  synthetic
GFTFSSYD

SEQ ID NO: 1149 - DNA, 24 bp, Artificial Sequence
  synthetic
attagtagtagtggtaataccata

SEQ ID NO: 1150 - protein, 8 aa, Artificial Sequence
  synthetic
ISSSGNTI

SEQ ID NO: 1151 - DNA, 60 bp, Artificial Sequence
  synthetic
gcgaaagccggtcccgctacggtgacacggaggtactactactactacggtttggacgtc

SEQ ID NO: 1152 - protein, 20 aa, Artificial Sequence
  synthetic
AKAGPATVTRRYYYYYGLDV

SEQ ID NO: 1153 - DNA, 324 bp, Artificial Sequence
  synthetic
gacatcgtgatgacccagtctccatcctccctgtctgcatctgtacgagacagagtcaccatcacttgccgggcaagtcagagaattagcagctatttaaattggtttcagcagaaaccagggaaagcccctaaggtcctgatctatactgcatccagtttgcaaaatggggtcccatcaaggttcagtggcagtggatctgggacagatttcactctcaccatcagcagtctgcaacctgaagactttgcaacttactactgtcagcagagttacaggaccccgctcactttcggcggagggaccaaggtggagatcaaacga

SEQ ID NO: 1154 - protein, 108 aa, Artificial Sequence
  synthetic
DIVMTQSPSSLSASVRDRVTITCRASQRISSYLNWFQQKPGKAPKVLIYTASSLQNGVPSRFSGSGSGTDFTLTISSLQPEDFATYYCQQSYRTPLTFGGGTKVEIKR

SEQ ID NO: 1155 - DNA, 18 bp, Artificial Sequence
  synthetic
cagagaattagcagctat

SEQ ID NO: 1156 - protein, 6 aa, Artificial Sequence
  synthetic
QRISSY

SEQ ID NO: 1157 - DNA, 9 bp, Artificial Sequence
  synthetic
actgcatcc

SEQ ID NO: 1158 - protein, 3 aa, Artificial Sequence
  synthetic
TAS

SEQ ID NO: 1159 - DNA, 27 bp, Artificial Sequence
  synthetic
cagcagagttacaggaccccgctcact

SEQ ID NO: 1160 - protein, 9 aa, Artificial Sequence
  synthetic
QQSYRTPLT

SEQ ID NO: 1161 - DNA, 354 bp, Artificial Sequence
  synthetic
caggtgcagctggtacagtctggggctgaggtgaagaagcctggggcctcagtgaaggtctcctgcaaggcttctggatacacattcatcggctactatatgcactgggtgcgacaggcccctggacaagggcttgagtggatgggatggatcaaccctaaaagtggtggcacaaactatgcacagaagtttcagggcagggtcaccatgaccggggacacgtccatcagcacagcctacatggagctgagcaggctgagatctgacgacacggccgtgttttactgtgcgagaatgggggacggtgcaatgtttgactactggggccagggaaccctggtcaccgtctcctca

SEQ ID NO: 1162 - protein, 118 aa, Artificial Sequence
  synthetic
QVQLVQSGAEVKKPGASVKVSCKASGYTFIGYYMHWVRQAPGQGLEWMGWINPKSGGTNYAQKFQGRVTMTGDTSISTAYMELSRLRSDDTAVFYCARMGDGAMFDYWGQGTLVTVSS

SEQ ID NO: 1163 - DNA, 24 bp, Artificial Sequence
  synthetic
ggatacacattcatcggctactat

SEQ ID NO: 1164 - protein, 8 aa, Artificial Sequence
  synthetic
GYTFIGYY

SEQ ID NO: 1165 - DNA, 24 bp, Artificial Sequence
  synthetic
atcaaccctaaaagtggtggcaca

SEQ ID NO: 1166 - protein, 8 aa, Artificial Sequence
  synthetic
INPKSGGT

SEQ ID NO: 1167 - DNA, 33 bp, Artificial Sequence
  synthetic
gcgagaatgggggacggtgcaatgtttgactac

SEQ ID NO: 1168 - protein, 11 aa, Artificial Sequence
  synthetic
ARMGDGAMFDY

SEQ ID NO: 1169 - DNA, 321 bp, Artificial Sequence
  synthetic
gacatccagatgacccagtctccatcctccctgtctgcatctgtaggagacagagtcaccatcacttgccgggcaagtcagagaattagcagctatttaaattggtatcagcagaaagcagggaaagcccctaaggtcctgatctatactgcatccagtttgcaaagtggggtcccatcacgattcagtggcagtggatctgggacagatttcactctcaccatcagcagtctgcaacctgaagattttgcaacttactactgtcaacagagttacagtaccccgctcactttcggcggagggaccaaggtggagatcaaa

SEQ ID NO: 1170 - protein, 107 aa, Artificial Sequence
  synthetic
DIQMTQSPSSLSASVGDRVTITCRASQRISSYLNWYQQKAGKAPKVLIYTASSLQSGVPSRFSGSGSGTDFTLTISSLQPEDFATYYCQQSYSTPLTFGGGTKVEIK

SEQ ID NO: 1171 - DNA, 18 bp, Artificial Sequence
  synthetic
cagagaattagcagctat

SEQ ID NO: 1172 - protein, 6 aa, Artificial Sequence
  synthetic
QRISSY

SEQ ID NO: 1173 - DNA, 9 bp, Artificial Sequence
  synthetic
actgcatcc

SEQ ID NO: 1174 - protein, 3 aa, Artificial Sequence
  synthetic
TAS

SEQ ID NO: 1175 - DNA, 27 bp, Artificial Sequence
  synthetic
caacagagttacagtaccccgctcact

SEQ ID NO: 1176 - protein, 9 aa, Artificial Sequence
  synthetic
QQSYSTPLT

SEQ ID NO: 1177 - DNA, 375 bp, Artificial Sequence
  synthetic
caggtgcagctggtacagtctgggggaggcgtggtacagcctggggggtccctgagactctcctgtgcagcctctggattcacctttgatgattatgccatgcactgggtccgtcaagctccagggaagggtctggagtgggtctctcttattagtggggatggtggtagcacatactatgcagactctgtgaagggccgattcaccatctccagagacaacagcaaaaactccctgtatctgcaaatgaacagtctgagaactgaggacaccgccttgtattactgtgcaaaagatgatagcagctcgtcctggtactactactactacggtatggacgtctggggccgagggaccacggtcaccgtctcctca

SEQ ID NO: 1178 - protein, 125 aa, Artificial Sequence
  synthetic
QVQLVQSGGGVVQPGGSLRLSCAASGFTFDDYAMHWVRQAPGKGLEWVSLISGDGGSTYYADSVKGRFTISRDNSKNSLYLQMNSLRTEDTALYYCAKDDSSSSWYYYYYGMDVWGRGTTVTVSS

SEQ ID NO: 1179 - DNA, 24 bp, Artificial Sequence
  synthetic
ggattcacctttgatgattatgcc

SEQ ID NO: 1180 - protein, 8 aa, Artificial Sequence
  synthetic
GFTFDDYA

SEQ ID NO: 1181 - DNA, 24 bp, Artificial Sequence
  synthetic
attagtggggatggtggtagcaca

SEQ ID NO: 1182 - protein, 8 aa, Artificial Sequence
  synthetic
ISGDGGST

SEQ ID NO: 1183 - DNA, 54 bp, Artificial Sequence
  synthetic
gcaaaagatgatagcagctcgtcctggtactactactactacggtatggacgtc

SEQ ID NO: 1184 - protein, 18 aa, Artificial Sequence
  synthetic
AKDDSSSSWYYYYYGMDV

SEQ ID NO: 1185 - DNA, 324 bp, Artificial Sequence
  synthetic
gacatccagatgacccagtctccatcctccctgtctgcatctgtaggagacagagtcaccatcacttgccgggcaagtcagcgcattagcagctatttaaattggtatcagcagaaaccagggaaagcccctaaggtgctgatctctgttgcatccagtttgcaaagtggggtcccatcaaggttcagtggcagtggatctgggacagatttcactctcaccatcagcagtctgcaacctgaggattttgcatcttactactgtcaacagagttacaataccccgctcactttcggcggagggaccaaggtggagatcaaacga

SEQ ID NO: 1186 - protein, 108 aa, Artificial Sequence; identical to SEQ ID NO: 1138
  synthetic

SEQ ID NO: 1187 - DNA, 18 bp, Artificial Sequence
  synthetic
cagcgcattagcagctat

SEQ ID NO: 1188 - protein, 6 aa, Artificial Sequence
  synthetic
QRISSY

SEQ ID NO: 1189 - DNA, 9 bp, Artificial Sequence
  synthetic
gttgcatcc

SEQ ID NO: 1190 - protein, 3 aa, Artificial Sequence
  synthetic
VAS

SEQ ID NO: 1191 - DNA, 27 bp, Artificial Sequence
  synthetic
caacagagttacaataccccgctcact

SEQ ID NO: 1192 - protein, 9 aa, Artificial Sequence
  synthetic
QQSYNTPLT

SEQ ID NO: 1193 - DNA, 372 bp, Artificial Sequence
  synthetic
gaggtgcagctggtggagtctgggggaggcttggtacagcctggcaggtccctgagactctcctgtgcagcctctggattcacctttggtgattataccatgcactgggtccggcaagctccagggaagggcctggagtgggtctccgatattagttggaatagtggtagcaaagactatgcggactctgtgaagggccgattcaccatctccagagacaacgccaagaactccctctatcttcaaatgaacagtctgagaactgaggatacggccttttattactgtgcaaaagatagtaggggctacggtctctactaccacctcggtttggacgtctggggccaagggaccacggtcaccgtctcctca

SEQ ID NO: 1194 - protein, 124 aa, Artificial Sequence
  synthetic
EVQLVESGGGLVQPGRSLRLSCAASGFTFGDYTMHWVRQAPGKGLEWVSDISWNSGSKDYADSVKGRFTISRDNAKNSLYLQMNSLRTEDTAFYYCAKDSRGYGLYYHLGLDVWGQGTTVTVSS

SEQ ID NO: 1195 - DNA, 24 bp, Artificial Sequence
  synthetic
ggattcacctttggtgattatacc

SEQ ID NO: 1196 - protein, 8 aa, Artificial Sequence
  synthetic
GFTFGDYT

SEQ ID NO: 1197 - DNA, 24 bp, Artificial Sequence
  synthetic
attagttggaatagtggtagcaaa

SEQ ID NO: 1198 - protein, 8 aa, Artificial Sequence
  synthetic
ISWNSGSK

SEQ ID NO: 1199 - DNA, 51 bp, Artificial Sequence
  synthetic
gcaaaagatagtaggggctacggtctctactaccacctcggtttggacgtc

SEQ ID NO: 1200 - protein, 17 aa, Artificial Sequence
  synthetic
AKDSRGYGLYYHLGLDV

SEQ ID NO: 1201 - DNA, 372 bp, Artificial Sequence
  synthetic
gaggtgcagctggtggagtctgggggaggcttggtgcagcctggcaggtccctgagactctcctgtgcagcctctggattcacctttgctgattataccatgcactgggtccggcaagctccagggaagggcctggagtgggtctcagatattagttggaatagtggtagtatagcctatgcggactctgtgaagggccgattcaccatctccagagacaacgccaagaactccctctatcttcaaatgaacagtctgagaactgaggacacggccttttattactgtgcaaaagatagtaggggctacggtcactataagtacctcggtttggacgtctggggccaagggaccacggtcaccgtctcctca

SEQ ID NO: 1202 - protein, 124 aa, Artificial Sequence
  synthetic
EVQLVESGGGLVQPGRSLRLSCAASGFTFADYTMHWVRQAPGKGLEWVSDISWNSGSIAYADSVKGRFTISRDNAKNSLYLQMNSLRTEDTAFYYCAKDSRGYGHYKYLGLDVWGQGTTVTVSS

SEQ ID NO: 1203 - DNA, 24 bp, Artificial Sequence
  synthetic
ggattcacctttgctgattatacc

SEQ ID NO: 1204 - protein, 8 aa, Artificial Sequence
  synthetic
GFTFADYT

SEQ ID NO: 1205 - DNA, 24 bp, Artificial Sequence
  synthetic
attagttggaatagtggtagtata

SEQ ID NO: 1206 - protein, 8 aa, Artificial Sequence
  synthetic
ISWNSGSI

SEQ ID NO: 1207 - DNA, 51 bp, Artificial Sequence
  synthetic
gcaaaagatagtaggggctacggtcactataagtacctcggtttggacgtc

SEQ ID NO: 1208 - protein, 17 aa, Artificial Sequence
  synthetic
AKDSRGYGHYKYLGLDV

SEQ ID NO: 1209 - DNA, 372 bp, Artificial Sequence
  synthetic
gaggtgcagctggtggagtctgggggaggcatggtacagcctggcaggtccctgagactctcctgtgcagcctctggattccccttcaatgattacaccatgcactgggtccggcaagtcccagggaggggcctggagtgggtctcagatattagttggaatagcggcagtaaaggctatgcggactctgtgaagggtcgattcatcatctccagagacaacgccaagaactccctgtacctgcaaatgaacagtctgagagttgaagacacggccttgtattactgtgtaaaagatggaagtggctacgggaggttccattattacgctatggacgtctggggccaagggaccacggtcaccgtctcctca

SEQ ID NO: 1210 - protein, 124 aa, Artificial Sequence
  synthetic
EVQLVESGGGMVQPGRSLRLSCAASGFPFNDYTMHWVRQVPGRGLEWVSDISWNSGSKGYADSVKGRFIISRDNAKNSLYLQMNSLRVEDTALYYCVKDGSGYGRFHYYAMDVWGQGTTVTVSS

SEQ ID NO: 1211 - DNA, 24 bp, Artificial Sequence
  synthetic
ggattccccttcaatgattacacc

SEQ ID NO: 1212 - protein, 8 aa, Artificial Sequence
  synthetic
GFPFNDYT

SEQ ID NO: 1213 - DNA, 24 bp, Artificial Sequence
  synthetic
attagttggaatagcggcagtaaa

SEQ ID NO: 1214 - protein, 8 aa, Artificial Sequence
  synthetic
ISWNSGSK

SEQ ID NO: 1215 - DNA, 51 bp, Artificial Sequence
  synthetic
gtaaaagatggaagtggctacgggaggttccattattacgctatggacgtc

SEQ ID NO: 1216 - protein, 17 aa, Artificial Sequence
  synthetic
VKDGSGYGRFHYYAMDV

SEQ ID NO: 1217 - DNA, 372 bp, Artificial Sequence
  synthetic
gaggtgcagctggtggagtctggtggaggcttggtacagcctggcaggtccctgagactctcctgtgcagcctctggattcacctttgctgattataccatgcactgggtccgccaagttccagggaagggcctggagtgggtctcagatattagttggaatagtggtagcaaagactatgcggactctgtgaagggccgcttcaccatctccagagacaacgccaagaatttcctgtatctgcaaatgaacagtctgagagctgaagacacggccttgtattactgtgtaaaatatggaagtggctacgggaaattctacttctacgctatggacgtctggggccaagggaccacggtcaccgtctcctca

SEQ ID NO: 1218 - protein, 124 aa, Artificial Sequence
  synthetic
EVQLVESGGGLVQPGRSLRLSCAASGFTFADYTMHWVRQVPGKGLEWVSDISWNSGSKDYADSVKGRFTISRDNAKNFLYLQMNSLRAEDTALYYCVKYGSGYGKFYFYAMDVWGQGTTVTVSS

SEQ ID NO: 1219 - DNA, 24 bp, Artificial Sequence
  synthetic
ggattcacctttgctgattatacc

SEQ ID NO: 1220 - protein, 8 aa, Artificial Sequence
  synthetic
GFTFADYT

SEQ ID NO: 1221 - DNA, 24 bp, Artificial Sequence
  synthetic
attagttggaatagtggtagcaaa

SEQ ID NO: 1222 - protein, 8 aa, Artificial Sequence
  synthetic
ISWNSGSK

SEQ ID NO: 1223 - DNA, 51 bp, Artificial Sequence
  synthetic
gtaaaatatggaagtggctacgggaaattctacttctacgctatggacgtc

SEQ ID NO: 1224 - protein, 17 aa, Artificial Sequence
  synthetic
VKYGSGYGKFYFYAMDV

SEQ ID NO: 1225 - DNA, 372 bp, Artificial Sequence
  synthetic
gaggtgcagctggtgcagtctgggggaggcttggtacagcctggcaggtccctgagactctcctgtgcagcctctggattcacctttgctgattataccatgcactgggtccggcaaactccagggaagggcctggagtgggtctcaggtattagttggaatagtggtagcaaagactatgcggactctgtgaagggccgattcaccatctccagagacaacgccaagaactccctgtatctgcaaatgaacagtctgagaactgaggacacggccttgtattactgtgcaaaatatggaagtggctacgggagatatttcttctacgctatggacgtctggggccaagggaccacggtcaccgtctcctca

SEQ ID NO: 1226 - protein, 124 aa, Artificial Sequence
  synthetic
EVQLVQSGGGLVQPGRSLRLSCAASGFTFADYTMHWVRQTPGKGLEWVSGISWNSGSKDYADSVKGRFTISRDNAKNSLYLQMNSLRTEDTALYYCAKYGSGYGRYFFYAMDVWGQGTTVTVSS

SEQ ID NO: 1227 - DNA, 24 bp, Artificial Sequence
  synthetic
ggattcacctttgctgattatacc

SEQ ID NO: 1228 - protein, 8 aa, Artificial Sequence
  synthetic
GFTFADYT

SEQ ID NO: 1229 - DNA, 24 bp, Artificial Sequence
  synthetic
attagttggaatagtggtagcaaa

SEQ ID NO: 1230 - protein, 8 aa, Artificial Sequence
  synthetic
ISWNSGSK

SEQ ID NO: 1231 - DNA, 51 bp, Artificial Sequence
  synthetic
gcaaaatatggaagtggctacgggagatatttcttctacgctatggacgtc

SEQ ID NO: 1232 - protein, 17 aa, Artificial Sequence
  synthetic
AKYGSGYGRYFFYAMDV

SEQ ID NO: 1233 - DNA, 372 bp, Artificial Sequence
  synthetic
gaggtgcagctggtggagtcaaggggagccttggtacagcctggcaggtccctgagactctcctgtgcagcctctggattcgcctttaatgattataccatgcactgggtccggcaagctccagggaagggcctggagtgggtctcagatattagttggaatagtaatagtaaagactatgcggactctgtgaagggccgattcaccatctccagagacaatgccaagaactccctctatctacaaatgaacagtctgagagctgaggacacggccttgtattactgtgtaaaagatggaagtggctacgggaaattttccctctacgctttggacgtctggggccaagggaccacggtcaccgtctcctca

SEQ ID NO: 1234 - protein, 124 aa, Artificial Sequence
  synthetic
EVQLVESRGALVQPGRSLRLSCAASGFAFNDYTMHWVRQAPGKGLEWVSDISWNSNSKDYADSVKGRFTISRDNAKNSLYLQMNSLRAEDTALYYCVKDGSGYGKFSLYALDVWGQGTTVTVSS

SEQ ID NO: 1235 - DNA, 24 bp, Artificial Sequence
  synthetic
ggattcgcctttaatgattatacc

SEQ ID NO: 1236 - protein, 8 aa, Artificial Sequence
  synthetic
GFAFNDYT

SEQ ID NO: 1237 - DNA, 24 bp, Artificial Sequence
  synthetic
attagttggaatagtaatagtaaa

SEQ ID NO: 1238 - protein, 8 aa, Artificial Sequence
  synthetic
ISWNSNSK

SEQ ID NO: 1239 - DNA, 51 bp, Artificial Sequence
  synthetic
gtaaaagatggaagtggctacgggaaattttccctctacgctttggacgtc

SEQ ID NO: 1240 - protein, 17 aa, Artificial Sequence
  synthetic
VKDGSGYGKFSLYALDV

SEQ ID NO: 1241 - DNA, 372 bp, Artificial Sequence
  synthetic
caggtgcagctggtggagtctgggggaggcttggttcaccctggcaggtccctgagactctcctgtgcagcctctggattcaaatttgatgattataccatgcactgggtccggcaagctccagggaagggcctagagtgggtctcagatattagttggaatagtggtagtaaaggctatgcggactctgtgaagggccgattcaccatctccagagacaacgccaaggattccctatatctgcagatggacagtctgagagctgcagacacggccttctattactgtgcaaaagataaaagtggctacggccacttctactactacgctatggacgtctggggccaagggaccacggtcaccgtctcctca

SEQ ID NO: 1242 - protein, 124 aa, Artificial Sequence
  synthetic
QVQLVESGGGLVHPGRSLRLSCAASGFKFDDYTMHWVRQAPGKGLEWVSDISWNSGSKGYADSVKGRFTISRDNAKDSLYLQMDSLRAADTAFYYCAKDKSGYGHFYYYAMDVWGQGTTVTVSS

SEQ ID NO: 1243 - DNA, 24 bp, Artificial Sequence
  synthetic
ggattcaaatttgatgattatacc

SEQ ID NO: 1244 - protein, 8 aa, Artificial Sequence
  synthetic
GFKFDDYT

SEQ ID NO: 1245 - DNA, 24 bp, Artificial Sequence
  synthetic
attagttggaatagtggtagtaaa

SEQ ID NO: 1246 - protein, 8 aa, Artificial Sequence
  synthetic
ISWNSGSK

SEQ ID NO: 1247 - DNA, 51 bp, Artificial Sequence
  synthetic
gcaaaagataaaagtggctacggccacttctactactacgctatggacgtc

SEQ ID NO: 1248 - protein, 17 aa, Artificial Sequence
  synthetic
AKDKSGYGHFYYYAMDV

SEQ ID NO: 1249 - DNA, 372 bp, Artificial Sequence
  synthetic
gaggtgcagctggtggagtctgggggaggcttggtacaccctggcaggtccctaagactctcctgtacagcctctggattcaagtttgctgattataccatgcactgggtccggcaagctccagggaagggcctggagtgggtctcagatattagttggaatagtggtagtaaaggctatgcggactctgtaaagggccgattcaccatctccagagacaatgacaagaactccctgtatctgcaaatgaacagtctgagaggtgaggacacggccttgtattactgtgcaaaagatggaagtggctacgggaggttccacttctacgctatcgacgtctggggccaagggaccacggtcaccgtctcctca

SEQ ID NO: 1250 - protein, 124 aa, Artificial Sequence
  synthetic
EVQLVESGGGLVHPGRSLRLSCTASGFKFADYTMHWVRQAPGKGLEWVSDISWNSGSKGYADSVKGRFTISRDNDKNSLYLQMNSLRGEDTALYYCAKDGSGYGRFHFYAIDVWGQGTTVTVSS

SEQ ID NO: 1251 - DNA, 24 bp, Artificial Sequence
  synthetic
ggattcaagtttgctgattatacc

SEQ ID NO: 1252 - protein, 8 aa, Artificial Sequence
  synthetic
GFKFADYT

SEQ ID NO: 1253 - DNA, 24 bp, Artificial Sequence
  synthetic
attagttggaatagtggtagtaaa

SEQ ID NO: 1254 - protein, 8 aa, Artificial Sequence
  synthetic
ISWNSGSK

SEQ ID NO: 1255 - DNA, 51 bp, Artificial Sequence
  synthetic
gcaaaagatggaagtggctacgggaggttccacttctacgctatcgacgtc

SEQ ID NO: 1256 - protein, 17 aa, Artificial Sequence
  synthetic
AKDGSGYGRFHFYAIDV

SEQ ID NO: 1257 - DNA, 372 bp, Artificial Sequence
  synthetic
gaggtgcagctggtggagtctgggggaggcttggtacagcctggcaggtccctgagactctcctgtgtagcctctggattcacctttgatgattattccatgcactgggtccggcaagctccagggaagggcctggagtgggtctcaggtattagttggaatagtggtagcaaagactatgcggactctgtgaagggccgattcaccatctccagagacaacgccaagaactccctgtatctgcaaatgaacagtctgagagctgaagacacggccttgtattactgtgcaaaatatggaagtggctacgggaagttctaccactacggtttggacgtctggggccaagggaccacggtcaccgtctcctca

SEQ ID NO: 1258 - protein, 124 aa, Artificial Sequence
  synthetic
EVQLVESGGGLVQPGRSLRLSCVASGFTFDDYSMHWVRQAPGKGLEWVSGISWNSGSKDYADSVKGRFTISRDNAKNSLYLQMNSLRAEDTALYYCAKYGSGYGKFYHYGLDVWGQGTTVTVSS

SEQ ID NO: 1259 - DNA, 24 bp, Artificial Sequence
  synthetic
ggattcacctttgatgattattcc

SEQ ID NO: 1260 - protein, 8 aa, Artificial Sequence
  synthetic
GFTFDDYS

SEQ ID NO: 1261 - DNA, 24 bp, Artificial Sequence
  synthetic
attagttggaatagtggtagcaaa

SEQ ID NO: 1262 - protein, 8 aa, Artificial Sequence
  synthetic
ISWNSGSK

SEQ ID NO: 1263 - DNA, 51 bp, Artificial Sequence
  synthetic
gcaaaatatggaagtggctacgggaagttctaccactacggtttggacgtc

SEQ ID NO: 1264 - protein, 17 aa, Artificial Sequence
  synthetic
AKYGSGYGKFYHYGLDV

SEQ ID NO: 1265 - DNA, 372 bp, Artificial Sequence
  synthetic
caggtgcagttggtggagtctgggggaggcttggtacagcctggcaggtccctgagactctcctgtgcagcctctggattcacctttgctgattataccatgcactgggtccggcaggctccagggaagggcctggagtgggtctcagatattagttggaatagtggtagcatgggctatgcggactctgtgaagggccgattcaccatctccagagacaacgccaagaaatccctgtatctgcaaatgaacagtctgagaactgaggacacggccttgtattactgtgcaaaagatggaagtggctacgggaaatacttcttctacgctatggacgtctggggccaagggaccacggtcaccgtctcctca

SEQ ID NO: 1266 - protein, 124 aa, Artificial Sequence
  synthetic
QVQLVESGGGLVQPGRSLRLSCAASGFTFADYTMHWVRQAPGKGLEWVSDISWNSGSMGYADSVKGRFTISRDNAKKSLYLQMNSLRTEDTALYYCAKDGSGYGKYFFYAMDVWGQGTTVTVSS

SEQ ID NO: 1267 - DNA, 24 bp, Artificial Sequence
  synthetic
ggattcacctttgctgattatacc

SEQ ID NO: 1268 - protein, 8 aa, Artificial Sequence
  synthetic
GFTFADYT

SEQ ID NO: 1269 - DNA, 24 bp, Artificial Sequence
  synthetic
attagttggaatagtggtagcatg

SEQ ID NO: 1270 - protein, 8 aa, Artificial Sequence
  synthetic
ISWNSGSM

SEQ ID NO: 1271 - DNA, 51 bp, Artificial Sequence
  synthetic
gcaaaagatggaagtggctacgggaaatacttcttctacgctatggacgtc

SEQ ID NO: 1272 - protein, 17 aa, Artificial Sequence
  synthetic
AKDGSGYGKYFFYAMDV

SEQ ID NO: 1273 - DNA, 372 bp, Artificial Sequence
  synthetic
gaggtgcagctggtgcagtctgggggaggcttggtacagcctggcaggtccctgagactctcctgtgcagcctctggattcaccttttctgattatactatgcattgggtccggcaaggtccagggaagggcctggagtgggtctcagatattagttggaatagtggtagtaaaggctatacggactctgtgaagggccgattcaccatttccagagacaacgccaagaagtccctgtatctacaaatgaacagtctgagagctgaggacacggccttgtactactgtgtaaaagatggaagtggctacgggaaataccacttctacgctatggacgtctggggccaagggaccctggtcaccgtctcctca

SEQ ID NO: 1274 - protein, 124 aa, Artificial Sequence
  synthetic
EVQLVQSGGGLVQPGRSLRLSCAASGFTFSDYTMHWVRQGPGKGLEWVSDISWNSGSKGYTDSVKGRFTISRDNAKKSLYLQMNSLRAEDTALYYCVKDGSGYGKYHFYAMDVWGQGTLVTVSS

SEQ ID NO: 1275 - DNA, 24 bp, Artificial Sequence
  synthetic
ggattcaccttttctgattatact

SEQ ID NO: 1276 - protein, 8 aa, Artificial Sequence
  synthetic
GFTFSDYT

SEQ ID NO: 1277 - DNA, 24 bp, Artificial Sequence
  synthetic
attagttggaatagtggtagtaaa

SEQ ID NO: 1278 - protein, 8 aa, Artificial Sequence
  synthetic
ISWNSGSK

SEQ ID NO: 1279 - DNA, 51 bp, Artificial Sequence
  synthetic
gtaaaagatggaagtggctacgggaaataccacttctacgctatggacgtc

SEQ ID NO: 1280 - protein, 17 aa, Artificial Sequence
  synthetic
VKDGSGYGKYHFYAMDV

SEQ ID NO: 1281 - DNA, 372 bp, Artificial Sequence
  synthetic
gaggtgcagctggtggagtcggggggaggcttggttcaccctggcaggtccctgagactctcctgtgcagcctctggattcacctttgatgattataccatgcactgggtccggcaagctccagggaagggcctggaatgggtctcagatattagttggaatagtggtagcagaggctatgcggactctgtgaagggccgattcaccatctccagagataatgccgagaactccctgtacctgcaaatgaacagtctgagagctgaggacacggccttgtattactgtgcaaaagataaaagtggctacggccactactactactacgctatggacgtctggggccaagggaccacggtcaccgtctcctca

SEQ ID NO: 1282 - protein, 124 aa, Artificial Sequence
  synthetic
EVQLVESGGGLVHPGRSLRLSCAASGFTFDDYTMHWVRQAPGKGLEWVSDISWNSGSRGYADSVKGRFTISRDNAENSLYLQMNSLRAEDTALYYCAKDKSGYGHYYYYAMDVWGQGTTVTVSS

SEQ ID NO: 1283 - DNA, 24 bp, Artificial Sequence
  synthetic
ggattcacctttgatgattatacc

SEQ ID NO: 1284 - protein, 8 aa, Artificial Sequence
  synthetic
GFTFDDYT

SEQ ID NO: 1285 - DNA, 24 bp, Artificial Sequence
  synthetic
attagttggaatagtggtagcaga

SEQ ID NO: 1286 - protein, 8 aa, Artificial Sequence
  synthetic
ISWNSGSR

SEQ ID NO: 1287 - DNA, 51 bp, Artificial Sequence
  synthetic
gcaaaagataaaagtggctacggccactactactactacgctatggacgtc

SEQ ID NO: 1288 - protein, 17 aa, Artificial Sequence
  synthetic
AKDKSGYGHYYYYAMDV

SEQ ID NO: 1289 - DNA, 372 bp, Artificial Sequence
  synthetic
gaggtgcagctggtggagtctgggggaggcttggtacagcctggcgggtccctgagactctcctgtgaagcctctggattcacctttgctgattataccttgcactgggtccggcaagctccagggaagggcctggaatgggtctcagatattagttggaatagtggcaccagaggctatgcggactctgtgaggggccgattcaccatctccagagacaacgccaagaagtccctgtatctgcaaatgaacagtctgagatctgaggacacggccttgtattactgtgtgaaagatggaagtggctacgggagatataatttctacgctatggacgtctggggccaagggaccacggtcaccgtctcctca

SEQ ID NO: 1290 - protein, 124 aa, Artificial Sequence
  synthetic
EVQLVESGGGLVQPGGSLRLSCEASGFTFADYTLHWVRQAPGKGLEWVSDISWNSGTRGYADSVRGRFTISRDNAKKSLYLQMNSLRSEDTALYYCVKDGSGYGRYNFYAMDVWGQGTTVTVSS

SEQ ID NO: 1291 - DNA, 24 bp, Artificial Sequence
  synthetic
ggattcacctttgctgattatacc

SEQ ID NO: 1292 - protein, 8 aa, Artificial Sequence
  synthetic
GFTFADYT

SEQ ID NO: 1293 - DNA, 24 bp, Artificial Sequence
  synthetic
attagttggaatagtggcaccaga

SEQ ID NO: 1294 - protein, 8 aa, Artificial Sequence
  synthetic
ISWNSGTR

SEQ ID NO: 1295 - DNA, 51 bp, Artificial Sequence
  synthetic
gtgaaagatggaagtggctacgggagatataatttctacgctatggacgtc

SEQ ID NO: 1296 - protein, 17 aa, Artificial Sequence
  synthetic
VKDGSGYGRYNFYAMDV

SEQ ID NO: 1297 - DNA, 369 bp, Artificial Sequence
  synthetic
gaggtgcagctggtggagtctgggggaggcttggttcagcctggcaggtccctgagactctcctgtgcagcctctggatttacctttgctgactataccatgcactgggtccggcaaggtccagggaagggcctggagtgggtctcagatattggttggaatagtaatactataggctatgcggactctgtgaagggccgattcgccatctccagagacaacgccaagaactccctgtatcttcaaatgaacagtctgcgacctgaggacacggccttatattactgtgtaaaggataaaagtggctacgggaaattccaatacggtttggacgtctggggccaagggaccacggtcaccgtctcctca

SEQ ID NO: 1298 - protein, 123 aa, Artificial Sequence
  synthetic
EVQLVESGGGLVQPGRSLRLSCAASGFTFADYTMHWVRQGPGKGLEWVSDIGWNSNTIGYADSVKGRFAISRDNAKNSLYLQMNSLRPEDTALYYCVKDKSGYGKFQYGLDVWGQGTTVTVSS

SEQ ID NO: 1299 - DNA, 24 bp, Artificial Sequence
  synthetic
ggatttacctttgctgactatacc

SEQ ID NO: 1300 - protein, 8 aa, Artificial Sequence
  synthetic
GFTFADYT

SEQ ID NO: 1301 - DNA, 24 bp, Artificial Sequence
  synthetic
attggttggaatagtaatactata

SEQ ID NO: 1302 - protein, 8 aa, Artificial Sequence
  synthetic
IGWNSNTI

SEQ ID NO: 1303 - DNA, 48 bp, Artificial Sequence
  synthetic
gtaaaggataaaagtggctacgggaaattccaatacggtttggacgtc

SEQ ID NO: 1304 - protein, 16 aa, Artificial Sequence
  synthetic
VKDKSGYGKFQYGLDV

SEQ ID NO: 1305 - DNA, 369 bp, Artificial Sequence
  synthetic
gaggtgcagctggtggagtctgggggaggcttggtacagcctggcaggtccctgagactctcctgtgcagcctctggatttacatttgacgattataccatgcactgggtccggcaaggtccagggaagggcctggagtgggtctcagatattggttggaatagtaacagtataggctatgcggactctgtgaagggccgattcaccatctccagagacaacgccaagaactccctgtatctccaaatgaacagtctgagacctgaggacacggccttgtatttctgtgtaaaggataaaagtggctacgggaaatttttcatcggtttggacgtctggggccaagggacaatggtcaccgtctcttca

SEQ ID NO: 1306 - protein, 123 aa, Artificial Sequence
  synthetic
EVQLVESGGGLVQPGRSLRLSCAASGFTFDDYTMHWVRQGPGKGLEWVSDIGWNSNSIGYADSVKGRFTISRDNAKNSLYLQMNSLRPEDTALYFCVKDKSGYGKFFIGLDVWGQGTMVTVSS

SEQ ID NO: 1307 - DNA, 24 bp, Artificial Sequence
  synthetic
ggatttacatttgacgattatacc

SEQ ID NO: 1308 - protein, 8 aa, Artificial Sequence
  synthetic
GFTFDDYT

SEQ ID NO: 1309 - DNA, 24 bp, Artificial Sequence
  synthetic
attggttggaatagtaacagtata

SEQ ID NO: 1310 - protein, 8 aa, Artificial Sequence
  synthetic
IGWNSNSI

SEQ ID NO: 1311 - DNA, 48 bp, Artificial Sequence
  synthetic
gtaaaggataaaagtggctacgggaaatttttcatcggtttggacgtc

SEQ ID NO: 1312 - protein, 16 aa, Artificial Sequence
  synthetic
VKDKSGYGKFFIGLDV

SEQ ID NO: 1313 - DNA, 369 bp, Artificial Sequence
  synthetic
caggtgcagttggtggagtctgggggaggcttggtacagcctggcaggtccctgagactctcctgtgcagcctctggatttacatttgacgattataccatgcactgggtccggcaaggtccagggaagggcctggagtgggtctcagatattggttggaatagtaatactaaaggctatgcggactctgtgaagggccgattcaccatctccagagacaacgccaagaattccctgtatctccaaatgaacagtctgagacctgaggacacggccttgtatttctgtgtgaaggataaaagtggctacgggaaatttttcatcggtttggacgtctggggccaagggacaatggtcaccgtctcttca

SEQ ID NO: 1314 - protein, 123 aa, Artificial Sequence
  synthetic
QVQLVESGGGLVQPGRSLRLSCAASGFTFDDYTMHWVRQGPGKGLEWVSDIGWNSNTKGYADSVKGRFTISRDNAKNSLYLQMNSLRPEDTALYFCVKDKSGYGKFFIGLDVWGQGTMVTVSS

SEQ ID NO: 1315 - DNA, 24 bp, Artificial Sequence
  synthetic
ggatttacatttgacgattatacc

SEQ ID NO: 1316 - protein, 8 aa, Artificial Sequence
  synthetic
GFTFDDYT

SEQ ID NO: 1317 - DNA, 24 bp, Artificial Sequence
  synthetic
attggttggaatagtaatactaaa

SEQ ID NO: 1318 - protein, 8 aa, Artificial Sequence
  synthetic
IGWNSNTK

SEQ ID NO: 1319 - DNA, 48 bp, Artificial Sequence
  synthetic
gtgaaggataaaagtggctacgggaaatttttcatcggtttggacgtc

SEQ ID NO: 1320 - protein, 16 aa, Artificial Sequence
  synthetic
VKDKSGYGKFFIGLDV

SEQ ID NO: 1321 - DNA, 369 bp, Artificial Sequence
  synthetic
gaggtgcagctggtggagtctgggggaggcttggtccagcctgggcggtccctgagactctcctgtgcagcctccggattcacctttgctgattataccatgcactgggtccggcaaggtccagggacgggcctggagtgggtctcagatattggttggagtggtggtagtttaggctatgcggactctgtgaagggccgattcaccatctccagagacaacgccaagaactccctgtatttggaaatgaacaatctgcgacctgaagacacggccttgtattattgtgtaaaggataaaagtggctacgggaaattccagtacggtttggacgtctggggccaagggaccacggtcaccgtctcctca

SEQ ID NO: 1322 - protein, 123 aa, Artificial Sequence
  synthetic
EVQLVESGGGLVQPGRSLRLSCAASGFTFADYTMHWVRQGPGTGLEWVSDIGWSGGSLGYADSVKGRFTISRDNAKNSLYLEMNNLRPEDTALYYCVKDKSGYGKFQYGLDVWGQGTTVTVSS

SEQ ID NO: 1323 - DNA, 24 bp, Artificial Sequence
  synthetic
ggattcacctttgctgattatacc

SEQ ID NO: 1324 - protein, 8 aa, Artificial Sequence
  synthetic
GFTFADYT

SEQ ID NO: 1325 - DNA, 24 bp, Artificial Sequence
  synthetic
attggttggagtggtggtagttta

SEQ ID NO: 1326 - protein, 8 aa, Artificial Sequence
  synthetic
IGWSGGSL

SEQ ID NO: 1327 - DNA, 48 bp, Artificial Sequence
  synthetic
gtaaaggataaaagtggctacgggaaattccagtacggtttggacgtc

SEQ ID NO: 1328 - protein, 16 aa, Artificial Sequence
  synthetic
VKDKSGYGKFQYGLDV

SEQ ID NO: 1329 - DNA, 369 bp, Artificial Sequence
  synthetic
gaggtgcagctggtggagtctgggggaggcgtggtacagcctggcaggtccctgagactctcctgtgcagcctctgggtttaaatttgatggttataccatgcactgggtccggcaaggtccagggaagggcctggagtgggtctcagatattggttggaatagtaacactataggctatgcggactctgtgaagggccgattcaccatctccagagacaacgccaagaactccctgtatctccaaatgaacagtctgagaccagaggacacggccttgtatttctgtgtaaaggataaaagtggctacgggaaatttttcatcggtttggacgtctggggccaagggacaatggtcaccgtctcttca

SEQ ID NO: 1330 - protein, 123 aa, Artificial Sequence
  synthetic
EVQLVESGGGVVQPGRSLRLSCAASGFKFDGYTMHWVRQGPGKGLEWVSDIGWNSNTIGYADSVKGRFTISRDNAKNSLYLQMNSLRPEDTALYFCVKDKSGYGKFFIGLDVWGQGTMVTVSS

SEQ ID NO: 1331 - DNA, 24 bp, Artificial Sequence
  synthetic
gggtttaaatttgatggttatacc

SEQ ID NO: 1332 - protein, 8 aa, Artificial Sequence
  synthetic
GFKFDGYT

SEQ ID NO: 1333 - DNA, 24 bp, Artificial Sequence
  synthetic
attggttggaatagtaacactata

SEQ ID NO: 1334 - protein, 8 aa, Artificial Sequence
  synthetic
IGWNSNTI

SEQ ID NO: 1335 - DNA, 48 bp, Artificial Sequence; identical to SEQ ID NO: 1311
  synthetic

SEQ ID NO: 1336 - protein, 16 aa, Artificial Sequence
  synthetic
VKDKSGYGKFFIGLDV

SEQ ID NO: 1337 - DNA, 369 bp, Artificial Sequence
  synthetic
caggtgcagctggtggagtctgggggaggcttggtacagcctggcaggtccctgagactctcctgtgcagcctctggattcacctttgatgattataccatgcactgggtccggcaaggtccagggaagggcctggagtgggtctcagatattggttggaatagtaatactataggctatgcggactctgtgaagggccgattcaccatctccagagacaacgccaggaactccctgtatctgcaaatgaacagtctgcgacctgaagacacggccttatattactgtgtaaaggataaaagtggctacgggaaattccaatacggtttggacgtctggggccaagggaccacggtcaccgtctcctca

SEQ ID NO: 1338 - protein, 123 aa, Artificial Sequence
  synthetic
QVQLVESGGGLVQPGRSLRLSCAASGFTFDDYTMHWVRQGPGKGLEWVSDIGWNSNTIGYADSVKGRFTISRDNARNSLYLQMNSLRPEDTALYYCVKDKSGYGKFQYGLDVWGQGTTVTVSS

SEQ ID NO: 1339 - DNA, 24 bp, Artificial Sequence
  synthetic
ggattcacctttgatgattatacc

SEQ ID NO: 1340 - protein, 8 aa, Artificial Sequence
  synthetic
GFTFDDYT

SEQ ID NO: 1341 - DNA, 24 bp, Artificial Sequence
  synthetic
attggttggaatagtaatactata

SEQ ID NO: 1342 - protein, 8 aa, Artificial Sequence
  synthetic
IGWNSNTI

SEQ ID NO: 1343 - DNA, 48 bp, Artificial Sequence; identical to SEQ ID NO: 1303
  synthetic

SEQ ID NO: 1344 - protein, 16 aa, Artificial Sequence
  synthetic
VKDKSGYGKFQYGLDV

SEQ ID NO: 1345 - DNA, 369 bp, Artificial Sequence
  synthetic
caggtgcaactggtggagtctgggggaggcttggtacagcctggcaggtccctgagactctcctgtgcagcctctggattcaagtttgatgattataccatgcactgggtccggcaaggtccagggaagggcctggagtgggtctcagacattagttggagtggtggtagcatagactatacggactctgtgaagggccgattctccatctccagagacaacgccaagaactccctgtatctgcaaatgaacagtctgagagttgaagacacggccttgtattattgtgtaaaagataaaagtggctacgggaagtactcttacggtttggacgtctggggccaagggaccacggtcaccgtctcctca

SEQ ID NO: 1346 - protein, 123 aa, Artificial Sequence
  synthetic
QVQLVESGGGLVQPGRSLRLSCAASGFKFDDYTMHWVRQGPGKGLEWVSDISWSGGSIDYTDSVKGRFSISRDNAKNSLYLQMNSLRVEDTALYYCVKDKSGYGKYSYGLDVWGQGTTVTVSS

SEQ ID NO: 1347 - DNA, 24 bp, Artificial Sequence
  synthetic
ggattcaagtttgatgattatacc

SEQ ID NO: 1348 - protein, 8 aa, Artificial Sequence
  synthetic
GFKFDDYT

SEQ ID NO: 1349 - DNA, 24 bp, Artificial Sequence
  synthetic
attagttggagtggtggtagcata

SEQ ID NO: 1350 - protein, 8 aa, Artificial Sequence
  synthetic
ISWSGGSI

SEQ ID NO: 1351 - DNA, 48 bp, Artificial Sequence
  synthetic
gtaaaagataaaagtggctacgggaagtactcttacggtttggacgtc

SEQ ID NO: 1352 - protein, 16 aa, Artificial Sequence
  synthetic
VKDKSGYGKYSYGLDV

SEQ ID NO: 1353 - DNA, 357 bp, Artificial Sequence
  synthetic
gaggtgcagctggtggagtctgggggaggcttggtaaagccgggggggtcccttagaatctcctgtgcagcctctggattctctttcattaacgcctggatgaactgggtccgccaggctccagggaaggggctggagtgggttggccgtattaaaagcataagtgatggtgggacaacagactacgctgcatccgtgaaaggcagattcaccatctcaagagaagattcaaaaaatatgctgtttctggaaatgaatagtctgaaaaccgaggacacagccgtgttttactgtaccacagaggtcgctagaactccgaactactggggccggggaaccctggtcaccgtctcctca

SEQ ID NO: 1354 - protein, 119 aa, Artificial Sequence
  synthetic
EVQLVESGGGLVKPGGSLRISCAASGFSFINAWMNWVRQAPGKGLEWVGRIKSISDGGTTDYAASVKGRFTISREDSKNMLFLEMNSLKTEDTAVFYCTTEVARTPNYWGRGTLVTVSS

SEQ ID NO: 1355 - DNA, 24 bp, Artificial Sequence
  synthetic
ggattctctttcattaacgcctgg

SEQ ID NO: 1356 - protein, 8 aa, Artificial Sequence
  synthetic
GFSFINAW

SEQ ID NO: 1357 - DNA, 30 bp, Artificial Sequence
  synthetic
attaaaagcataagtgatggtgggacaaca

SEQ ID NO: 1358 - protein, 10 aa, Artificial Sequence
  synthetic
IKSISDGGTT

SEQ ID NO: 1359 - DNA, 30 bp, Artificial Sequence
  synthetic
accacagaggtcgctagaactccgaactac

SEQ ID NO: 1360 - protein, 10 aa, Artificial Sequence
  synthetic
TTEVARTPNY

SEQ ID NO: 1361 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttatcattatggactggacgtgtggggacaagggacaacagtgacagtgagtagc

SEQ ID NO: 1362 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKYGSGYGKFYHYGLDVWGQGTTVTVSS

SEQ ID NO: 1363 - DNA, 24 bp, Artificial Sequence
  synthetic
gggtttacattcgacgattacagc

SEQ ID NO: 1364 - protein, 8 aa, Artificial Sequence
  synthetic
GFTFDDYS

SEQ ID NO: 1365 - DNA, 24 bp, Artificial Sequence
  synthetic
atatcatggaactcaggaagcaag

SEQ ID NO: 1366 - protein, 8 aa, Artificial Sequence
  synthetic
ISWNSGSK

SEQ ID NO: 1367 - DNA, 51 bp, Artificial Sequence
  synthetic
gcaaaatacggcagtggttatggcaagttttatcattatggactggacgtg

SEQ ID NO: 1368 - protein, 17 aa, Artificial Sequence
  synthetic
AKYGSGYGKFYHYGLDV

SEQ ID NO: 1369 - DNA, 372 bp, Artificial Sequence
  synthetic
gaagtacaactggtcgaatctggaggaggtcttgttcaacctggtcgatcacttcgcctttcttgtgccgcttctggtttcactttcgacgattatagcatgcattgggtacgacaggctcccggaaaagggctggaatgggtgtcaggaattagttggaactcaggaagtattggatacgctgattcagtcaaaggacgcttcacaatctcaagggacaacgctaaaaactcactttatttgcaaatgaactctctccgcgctgaagataccgctctctattattgcgccaaagatgggtctggttacggttatttttactactatggaatggacgtttggggccaaggaacaactgtcacagtatcatcc

SEQ ID NO: 1370 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGYFYYYGMDVWGQGTTVTVSS

SEQ ID NO: 1371 - DNA, 24 bp, Artificial Sequence
  synthetic
ggtttcactttcgacgattatagc

SEQ ID NO: 1372 - protein, 8 aa, Artificial Sequence
  synthetic
GFTFDDYS

SEQ ID NO: 1373 - DNA, 24 bp, Artificial Sequence
  synthetic
attagttggaactcaggaagtatt

SEQ ID NO: 1374 - protein, 8 aa, Artificial Sequence
  synthetic
ISWNSGSI

SEQ ID NO: 1375 - DNA, 51 bp, Artificial Sequence
  synthetic
gccaaagatgggtctggttacggttatttttactactatggaatggacgtt

SEQ ID NO: 1376 - protein, 17 aa, Artificial Sequence
  synthetic
AKDGSGYGYFYYYGMDV

SEQ ID NO: 1377 - DNA, 372 bp, Artificial Sequence
  synthetic
gaagtgcaactcgttgaaagcggaggaggactggtccagcccggcagatctctcagattgtcttgcgctgcatccggatttacatttgacgactattcaatgcactgggtacggcaagccccaggtaaaggactcgaatgggtaagcggcatatcttggaactcaggcagtattggctacgcagattcagtaaaaggaagattcactatttcaagggataatgctaagaacagtctctacttgcaaatgaatagcttgcgcgcagaagatacagcactttattattgtgcaaaagatggaagcggttatgggaaattttattattatggtatggatgtatggggtcaaggtacaacagttactgtgtcaagt

SEQ ID NO: 1378 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGKFYYYGMDVWGQGTTVTVSS

SEQ ID NO: 1379 - DNA, 24 bp, Artificial Sequence
  synthetic
ggatttacatttgacgactattca

SEQ ID NO: 1380 - protein, 8 aa, Artificial Sequence
  synthetic
GFTFDDYS

SEQ ID NO: 1381 - DNA, 24 bp, Artificial Sequence
  synthetic
atatcttggaactcaggcagtatt

SEQ ID NO: 1382 - protein, 8 aa, Artificial Sequence
  synthetic
ISWNSGSI

SEQ ID NO: 1383 - DNA, 51 bp, Artificial Sequence
  synthetic
gcaaaagatggaagcggttatgggaaattttattattatggtatggatgta

SEQ ID NO: 1384 - protein, 17 aa, Artificial Sequence
  synthetic
AKDGSGYGKFYYYGMDV

SEQ ID NO: 1385 - DNA, 324 bp, Artificial Sequence
  synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccgtcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 1386 - protein, 108 aa, Artificial Sequence; identical to SEQ ID NO: 610
  synthetic

SEQ ID NO: 1387 - DNA, 18 bp, Artificial Sequence
  synthetic
cagagcattagcagctat

SEQ ID NO: 1388 - protein, 6 aa, Artificial Sequence
  synthetic
QSISSY

SEQ ID NO: 1389 - DNA, 9 bp, Artificial Sequence
  synthetic
gctgcatcc

SEQ ID NO: 1390 - protein, 3 aa, Artificial Sequence
  synthetic
AAS

SEQ ID NO: 1391 - DNA, 30 bp, Artificial Sequence; identical to SEQ ID NO: 199
  synthetic

SEQ ID NO: 1392 - protein, 10 aa, Artificial Sequence
  synthetic
QQSYSTPPIT

SEQ ID NO: 1393 - DNA, 369 bp, Artificial Sequence; identical to SEQ ID NO: 265
  synthetic

SEQ ID NO: 1394 - protein, 123 aa, Artificial Sequence; identical to SEQ ID NO: 266
  synthetic

SEQ ID NO: 1395 - DNA, 24 bp, Artificial Sequence
  synthetic
ggattcacctttgatgattatacc

SEQ ID NO: 1396 - protein, 8 aa, Artificial Sequence
  synthetic
GFTFDDYT

SEQ ID NO: 1397 - DNA, 24 bp, Artificial Sequence
  synthetic
attagttggaatagtggtagtata

SEQ ID NO: 1398 - protein, 8 aa, Artificial Sequence
  synthetic
ISWNSGSI

SEQ ID NO: 1399 - DNA, 48 bp, Artificial Sequence; identical to SEQ ID NO: 271
  synthetic

SEQ ID NO: 1400 - protein, 16 aa, Artificial Sequence
  synthetic
AKDNSGYGHYYYGMDV

SEQ ID NO: 1401 - DNA, 320 bp, Artificial Sequence
  synthetic
gaaatagtgatgacgcagtctccagccaccctgtctgtgtctccaggggaaagagccaccctctcctgcagggccagtcagagtgttagcagcaacttagcctggtaccagcaaaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcactatattaactggcctctcactttcggcggagggaccaaggtggagatcaa

SEQ ID NO: 1402 - protein, 108 aa, Artificial Sequence
  synthetic
AEIVMTQSPATLSVSPGERATLSCRASQSVSSNLAWYQQKPGQAPRLLIYGASTRATGIPARFSGSGSGTEFTLTISSLQSEDFAVYYCQHYINWPLTFGGGTKVEIK

SEQ ID NO: 1403 - DNA, 18 bp, Artificial Sequence
  synthetic
cagagtgttagcagcaac

SEQ ID NO: 1404 - protein, 6 aa, Artificial Sequence
  synthetic
QSVSSN

SEQ ID NO: 1405 - DNA, 9 bp, Artificial Sequence
  synthetic
ggtgcatcc

SEQ ID NO: 1406 - protein, 3 aa, Artificial Sequence
  synthetic
GAS

SEQ ID NO: 1407 - DNA, 27 bp, Artificial Sequence
  synthetic
cagcactatattaactggcctctcact

SEQ ID NO: 1408 - protein, 9 aa, Artificial Sequence
  synthetic
QHYINWPLT

SEQ ID NO: 1409 - DNA, 369 bp, Artificial Sequence; identical to SEQ ID NO: 153
  synthetic

SEQ ID NO: 1410 - protein, 123 aa, Artificial Sequence; identical to SEQ ID NO: 154
  synthetic

SEQ ID NO: 1411 - DNA, 24 bp, Artificial Sequence
  synthetic
ggattcacctttgatgattttacc

SEQ ID NO: 1412 - protein, 8 aa, Artificial Sequence
  synthetic
GFTFDDFT

SEQ ID NO: 1413 - DNA, 24 bp, Artificial Sequence
  synthetic
atcagttggaatagtggtagcata

SEQ ID NO: 1414 - protein, 8 aa, Artificial Sequence
  synthetic
ISWNSGSI

SEQ ID NO: 1415 - DNA, 48 bp, Artificial Sequence; identical to SEQ ID NO: 159
  synthetic

SEQ ID NO: 1416 - protein, 16 aa, Artificial Sequence
  synthetic
AKDNSGYGYYYYGMDV

SEQ ID NO: 1417 - DNA, 321 bp, Artificial Sequence; identical to SEQ ID NO: 161
  synthetic

SEQ ID NO: 1418 - protein, 107 aa, Artificial Sequence; identical to SEQ ID NO: 162
  synthetic

SEQ ID NO: 1419 - DNA, 18 bp, Artificial Sequence
  synthetic
cacagtgttagcaggaac

SEQ ID NO: 1420 - protein, 6 aa, Artificial Sequence
  synthetic
HSVSRN

SEQ ID NO: 1421 - DNA, 9 bp, Artificial Sequence
  synthetic
ggtgcatcc

SEQ ID NO: 1422 - protein, 3 aa, Artificial Sequence
  synthetic
GAS

SEQ ID NO: 1423 - DNA, 27 bp, Artificial Sequence
  synthetic
cagcagtataataattggcctctcact

SEQ ID NO: 1424 - protein, 9 aa, Artificial Sequence
  synthetic
QQYNNWPLT

SEQ ID NO: 1425 - DNA, 369 bp, Artificial Sequence; identical to SEQ ID NO: 265
  synthetic

SEQ ID NO: 1426 - protein, 123 aa, Artificial Sequence; identical to SEQ ID NO: 266
  synthetic

SEQ ID NO: 1427 - DNA, 24 bp, Artificial Sequence
  synthetic
ggattcacctttgatgattatacc

SEQ ID NO: 1428 - protein, 8 aa, Artificial Sequence
  synthetic
GFTFDDYT

SEQ ID NO: 1429 - DNA, 24 bp, Artificial Sequence
  synthetic
attagttggaatagtggtagtata

SEQ ID NO: 1430 - protein, 8 aa, Artificial Sequence
  synthetic
ISWNSGSI

SEQ ID NO: 1431 - DNA, 48 bp, Artificial Sequence; identical to SEQ ID NO: 271
  synthetic

SEQ ID NO: 1432 - protein, 16 aa, Artificial Sequence
  synthetic
AKDNSGYGHYYYGMDV

SEQ ID NO: 1433 - DNA, 321 bp, Artificial Sequence; identical to SEQ ID NO: 273
  synthetic

SEQ ID NO: 1434 - protein, 107 aa, Artificial Sequence; identical to SEQ ID NO: 274
  synthetic

SEQ ID NO: 1435 - DNA, 18 bp, Artificial Sequence
  synthetic
cagagtgttagcagcaac

SEQ ID NO: 1436 - protein, 6 aa, Artificial Sequence
  synthetic
QSVSSN

SEQ ID NO: 1437 - DNA, 9 bp, Artificial Sequence
  synthetic
ggtgcatcc

SEQ ID NO: 1438 - protein, 3 aa, Artificial Sequence
  synthetic
GAS

SEQ ID NO: 1439 - DNA, 27 bp, Artificial Sequence
  synthetic
cagcactatattaactggcctctcact

SEQ ID NO: 1440 - protein, 9 aa, Artificial Sequence
  synthetic
QHYINWPLT

SEQ ID NO: 1441 - DNA, 354 bp, Artificial Sequence; identical to SEQ ID NO: 329
  synthetic

SEQ ID NO: 1442 - protein, 118 aa, Artificial Sequence; identical to SEQ ID NO: 330
  synthetic

SEQ ID NO: 1443 - DNA, 24 bp, Artificial Sequence
  synthetic
ggatttaccttcagaagttatgcc

SEQ ID NO: 1444 - protein, 8 aa, Artificial Sequence
  synthetic
GFTFRSYA

SEQ ID NO: 1445 - DNA, 24 bp, Artificial Sequence
  synthetic
gtatactatgatggaaataatcaa

SEQ ID NO: 1446 - protein, 8 aa, Artificial Sequence
  synthetic
VYYDGNNQ

SEQ ID NO: 1447 - DNA, 33 bp, Artificial Sequence; identical to SEQ ID NO: 303
  synthetic

SEQ ID NO: 1448 - protein, 11 aa, Artificial Sequence
  synthetic
ARGPGYNWLDP

SEQ ID NO: 1449 - DNA, 321 bp, Artificial Sequence; identical to SEQ ID NO: 337
  synthetic

SEQ ID NO: 1450 - protein, 107 aa, Artificial Sequence; identical to SEQ ID NO: 338
  synthetic

SEQ ID NO: 1451 - DNA, 18 bp, Artificial Sequence
  synthetic
cagagtgttagcaggaac

SEQ ID NO: 1452 - protein, 6 aa, Artificial Sequence
  synthetic
QSVSRN

SEQ ID NO: 1453 - DNA, 9 bp, Artificial Sequence
  synthetic
ggtgcatcc

SEQ ID NO: 1454 - protein, 3 aa, Artificial Sequence
  synthetic
GAS

SEQ ID NO: 1455 - DNA, 27 bp, Artificial Sequence
  synthetic
cagcagtataataactggcctctcact

SEQ ID NO: 1456 - protein, 9 aa, Artificial Sequence
  synthetic
QQYNNWPLT

SEQ ID NO: 1457 - DNA, 354 bp, Artificial Sequence; identical to SEQ ID NO: 313
  synthetic

SEQ ID NO: 1458 - protein, 118 aa, Artificial Sequence; identical to SEQ ID NO: 314
  synthetic

SEQ ID NO: 1459 - DNA, 24 bp, Artificial Sequence
  synthetic
ggattcaccttcagaagttatggc

SEQ ID NO: 1460 - protein, 8 aa, Artificial Sequence
  synthetic
GFTFRSYG

SEQ ID NO: 1461 - DNA, 24 bp, Artificial Sequence
  synthetic
atttactatgatggtaagaataaa

SEQ ID NO: 1462 - protein, 8 aa, Artificial Sequence
  synthetic
IYYDGKNK

SEQ ID NO: 1463 - DNA, 33 bp, Artificial Sequence; identical to SEQ ID NO: 319
  synthetic

SEQ ID NO: 1464 - protein, 11 aa, Artificial Sequence
  synthetic
ARGPGYNWLDP

SEQ ID NO: 1465 - DNA, 321 bp, Artificial Sequence; identical to SEQ ID NO: 321
  synthetic

SEQ ID NO: 1466 - protein, 107 aa, Artificial Sequence; identical to SEQ ID NO: 322
  synthetic

SEQ ID NO: 1467 - DNA, 18 bp, Artificial Sequence
  synthetic
cagagaattagcagcaac

SEQ ID NO: 1468 - protein, 6 aa, Artificial Sequence
  synthetic
QRISSN

SEQ ID NO: 1469 - DNA, 9 bp, Artificial Sequence
  synthetic
ggtgcatcc

SEQ ID NO: 1470 - protein, 3 aa, Artificial Sequence
  synthetic
GAS

SEQ ID NO: 1471 - DNA, 27 bp, Artificial Sequence
  synthetic
cagcaacatcataactggcctctcact

SEQ ID NO: 1472 - protein, 9 aa, Artificial Sequence
  synthetic
QQHHNWPLT

SEQ ID NO: 1473 - protein, 119 aa, Artificial Sequence
  synthetic
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 1474 - protein, 8 aa, Artificial Sequence
  synthetic
GYTFTRYT

SEQ ID NO: 1475 - protein, 8 aa, Artificial Sequence
  synthetic
INPSRGYT

SEQ ID NO: 1476 - protein, 12 aa, Artificial Sequence
  synthetic
ARYYDDHYCLDY

SEQ ID NO: 1477 - protein, 106 aa, Artificial Sequence
  synthetic
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 1478 - protein, 11 aa, Artificial Sequence
  synthetic
LSCRASQSVSY

SEQ ID NO: 1479 - protein, 3 aa, Artificial Sequence
  synthetic
DTS

SEQ ID NO: 1480 - protein, 9 aa, Artificial Sequence
  synthetic
QQWSSNPLT

SEQ ID NO: 1481 - DNA, 372 bp, Artificial Sequence; identical to SEQ ID NO: 1361
  synthetic

SEQ ID NO: 1482 - protein, 124 aa, Artificial Sequence; identical to SEQ ID NO: 1362
  synthetic

SEQ ID NO: 1483 - DNA, 24 bp, Artificial Sequence
  synthetic
gggtttacattcgacgattacagc

SEQ ID NO: 1484 - protein, 8 aa, Artificial Sequence
  synthetic
GFTFDDYS

SEQ ID NO: 1485 - DNA, 24 bp, Artificial Sequence
  synthetic
atatcatggaactcaggaagcaag

SEQ ID NO: 1486 - protein, 8 aa, Artificial Sequence
  synthetic
ISWNSGSK

SEQ ID NO: 1487 - DNA, 51 bp, Artificial Sequence; identical to SEQ ID NO: 1367
  synthetic

SEQ ID NO: 1488 - protein, 17 aa, Artificial Sequence
  synthetic
AKYGSGYGKFYHYGLDV

SEQ ID NO: 1489 - DNA, 372 bp, Artificial Sequence
  synthetic
gaagtacagttggtagaatctggaggaggactcgtgcaaccaggacgatcattgcggttgagttgtgctgctagtggattcacattcgacgactatgctatgcattgggtaagacaggctccaggaaaaggactcgaatgggtgtcaggaataagttggaactccggaagcattgggtacgcagattcagtcaaagggcgattcaccatatcccgagataacgctaagaactcactttaccttcaaatgaactctcttcgagcagaggacactgcactttattattgcgctaaggacggctccggttatggatatttttattattatggaatggacgtatggggacaaggcactactgttaccgttagttcc

SEQ ID NO: 1490 - protein, 124 aa, Artificial Sequence
  synthetic
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDGSGYGYFYYYGMDVWGQGTTVTVSS

SEQ ID NO: 1491 - DNA, 24 bp, Artificial Sequence
  synthetic
ggattcacattcgacgactatgct

SEQ ID NO: 1492 - protein, 8 aa, Artificial Sequence
  synthetic
GFTFDDYA

SEQ ID NO: 1493 - DNA, 24 bp, Artificial Sequence
  synthetic
ataagttggaactccggaagcatt

SEQ ID NO: 1494 - protein, 8 aa, Artificial Sequence
  synthetic
ISWNSGSI

SEQ ID NO: 1495 - DNA, 51 bp, Artificial Sequence
  synthetic
gctaaggacggctccggttatggatatttttattattatggaatggacgta

SEQ ID NO: 1496 - protein, 17 aa, Artificial Sequence
  synthetic
AKDGSGYGYFYYYGMDV

SEQ ID NO: 1497 - DNA, 372 bp, Artificial Sequence; identical to SEQ ID NO: 1369
  synthetic

SEQ ID NO: 1498 - protein, 124 aa, Artificial Sequence; identical to SEQ ID NO: 1370
  synthetic

SEQ ID NO: 1499 - DNA, 24 bp, Artificial Sequence
  synthetic
ggtttcactttcgacgattatagc

SEQ ID NO: 1500 - protein, 8 aa, Artificial Sequence
  synthetic
GFTFDDYS

SEQ ID NO: 1501 - DNA, 24 bp, Artificial Sequence
  synthetic
attagttggaactcaggaagtatt

SEQ ID NO: 1502 - protein, 8 aa, Artificial Sequence
  synthetic
ISWNSGSI

SEQ ID NO: 1503 - DNA, 51 bp, Artificial Sequence; identical to SEQ ID NO: 1375
  synthetic

SEQ ID NO: 1504 - protein, 17 aa, Artificial Sequence
  synthetic
AKDGSGYGYFYYYGMDV

SEQ ID NO: 1505 - DNA, 372 bp, Artificial Sequence
  synthetic
gaagttcaacttgtggaaagtggcggaggattggttcaaccaggacgttcattgaggctttcatgcgcagcttccggatttacatttgacgattacgcaatgcactgggttagacaggcaccaggaaaaggactggagtgggtgagcgggatttcatggaacagcggcagtatcggttatgcagactcagttaaaggaagattcaccatcagtagagacaacgcaaaaaattccctttatctccaaatgaactctcttagggccgaagatacagcattgtactactgcgcaaaagacggatcaggttacggaaaattttactactatggtatggatgtatggggtcagggaaccacagtaactgtatcaagc

SEQ ID NO: 1506 - protein, 124 aa, Artificial Sequence
  synthetic
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDGSGYGKFYYYGMDVWGQGTTVTVSS

SEQ ID NO: 1507 - DNA, 24 bp, Artificial Sequence
  synthetic
ggatttacatttgacgattacgca

SEQ ID NO: 1508 - protein, 8 aa, Artificial Sequence
  synthetic
GFTFDDYA

SEQ ID NO: 1509 - DNA, 24 bp, Artificial Sequence
  synthetic
atttcatggaacagcggcagtatc

SEQ ID NO: 1510 - protein, 8 aa, Artificial Sequence
  synthetic
ISWNSGSI

SEQ ID NO: 1511 - DNA, 51 bp, Artificial Sequence
  synthetic
gcaaaagacggatcaggttacggaaaattttactactatggtatggatgta

SEQ ID NO: 1512 - protein, 17 aa, Artificial Sequence
  synthetic
AKDGSGYGKFYYYGMDV

SEQ ID NO: 1513 - DNA, 372 bp, Artificial Sequence; identical to SEQ ID NO: 1377
  synthetic

SEQ ID NO: 1514 - protein, 124 aa, Artificial Sequence; identical to SEQ ID NO: 1378
  synthetic

SEQ ID NO: 1515 - DNA, 24 bp, Artificial Sequence
  synthetic
ggatttacatttgacgactattca

SEQ ID NO: 1516 - protein, 8 aa, Artificial Sequence
  synthetic
GFTFDDYS

SEQ ID NO: 1517 - DNA, 24 bp, Artificial Sequence
  synthetic
atatcttggaactcaggcagtatt

SEQ ID NO: 1518 - protein, 8 aa, Artificial Sequence
  synthetic
ISWNSGSI

SEQ ID NO: 1519 - DNA, 51 bp, Artificial Sequence; identical to SEQ ID NO: 1383
  synthetic

SEQ ID NO: 1520 - protein, 17 aa, Artificial Sequence
  synthetic
AKDGSGYGKFYYYGMDV

SEQ ID NO: 1521 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttatcattatggactggacgtgtggggacaagggacaacagtgacagtgagtagc

SEQ ID NO: 1522 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKYGSGYGKFYHYGLDVWGQGTTVTVSS

SEQ ID NO: 1523 - DNA, 24 bp, Artificial Sequence
  synthetic
gggtttacattcgacgattacagc

SEQ ID NO: 1524 - protein, 8 aa, Artificial Sequence
  synthetic
GFTFDDYS

SEQ ID NO: 1525 - DNA, 24 bp, Artificial Sequence
  synthetic
atatcatggaactcaggaagcatc

SEQ ID NO: 1526 - protein, 8 aa, Artificial Sequence
  synthetic
ISWNSGSI

SEQ ID NO: 1527 - DNA, 51 bp, Artificial Sequence; identical to SEQ ID NO: 1367
  synthetic

SEQ ID NO: 1528 - protein, 17 aa, Artificial Sequence
  synthetic
AKYGSGYGKFYHYGLDV

SEQ ID NO: 1529 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttatcattatggactggacgtgtggggacaagggacaacagtgacagtgagtagc

SEQ ID NO: 1530 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKDGSGYGKFYHYGLDVWGQGTTVTVSS

SEQ ID NO: 1531 - DNA, 24 bp, Artificial Sequence
  synthetic
gggtttacattcgacgattacagc

SEQ ID NO: 1532 - protein, 8 aa, Artificial Sequence
  synthetic
GFTFDDYS

SEQ ID NO: 1533 - DNA, 24 bp, Artificial Sequence
  synthetic
atatcatggaactcaggaagcaag

SEQ ID NO: 1534 - protein, 8 aa, Artificial Sequence
  synthetic
ISWNSGSK

SEQ ID NO: 1535 - DNA, 51 bp, Artificial Sequence
  synthetic
gcaaaagacggcagtggttatggcaagttttatcattatggactggacgtg

SEQ ID NO: 1536 - protein, 17 aa, Artificial Sequence
  synthetic
AKDGSGYGKFYHYGLDV

SEQ ID NO: 1537 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttattattatggactggacgtgtggggacaagggacaacagtgacagtgagtagc

SEQ ID NO: 1538 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKYGSGYGKFYYYGLDVWGQGTTVTVSS

SEQ ID NO: 1539 - DNA, 24 bp, Artificial Sequence
  synthetic
gggtttacattcgacgattacagc

SEQ ID NO: 1540 - protein, 8 aa, Artificial Sequence
  synthetic
GFTFDDYS

SEQ ID NO: 1541 - DNA, 24 bp, Artificial Sequence
  synthetic
atatcatggaactcaggaagcaag

SEQ ID NO: 1542 - protein, 8 aa, Artificial Sequence
  synthetic
ISWNSGSK

SEQ ID NO: 1543 - DNA, 51 bp, Artificial Sequence
  synthetic
gcaaaatacggcagtggttatggcaagttttattattatggactggacgtg

SEQ ID NO: 1544 - protein, 17 aa, Artificial Sequence
  synthetic
AKYGSGYGKFYYYGLDV

SEQ ID NO: 1545 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttatcattatggaatggacgtgtggggacaagggacaacagtgacagtgagtagc

SEQ ID NO: 1546 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKYGSGYGKFYHYGMDVWGQGTTVTVSS

SEQ ID NO: 1547 - DNA, 24 bp, Artificial Sequence
  synthetic
gggtttacattcgacgattacagc

SEQ ID NO: 1548 - protein, 8 aa, Artificial Sequence
  synthetic
GFTFDDYS

SEQ ID NO: 1549 - DNA, 24 bp, Artificial Sequence
  synthetic
atatcatggaactcaggaagcaag

SEQ ID NO: 1550 - protein, 8 aa, Artificial Sequence
  synthetic
ISWNSGSK

SEQ ID NO: 1551 - DNA, 51 bp, Artificial Sequence
  synthetic
gcaaaatacggcagtggttatggcaagttttatcattatggaatggacgtg

SEQ ID NO: 1552 - protein, 17 aa, Artificial Sequence
  synthetic
AKYGSGYGKFYHYGMDV

SEQ ID NO: 1553 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttatcattatggactggacgtgtggggacaagggacaacagtgacagtgagtagc

SEQ ID NO: 1554 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGKFYHYGLDVWGQGTTVTVSS

SEQ ID NO: 1555 - DNA, 24 bp, Artificial Sequence
  synthetic
gggtttacattcgacgattacagc

SEQ ID NO: 1556 - protein, 8 aa, Artificial Sequence
  synthetic
GFTFDDYS

SEQ ID NO: 1557 - DNA, 24 bp, Artificial Sequence
  synthetic
atatcatggaactcaggaagcatc

SEQ ID NO: 1558 - protein, 8 aa, Artificial Sequence
  synthetic
ISWNSGSI

SEQ ID NO: 1559 - DNA, 51 bp, Artificial Sequence; identical to SEQ ID NO: 1535
  synthetic

SEQ ID NO: 1560 - protein, 17 aa, Artificial Sequence
  synthetic
AKDGSGYGKFYHYGLDV

SEQ ID NO: 1561 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttattattatggactggacgtgtggggacaagggacaacagtgacagtgagtagc

SEQ ID NO: 1562 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKYGSGYGKFYYYGLDVWGQGTTVTVSS

SEQ ID NO: 1563 - DNA, 24 bp, Artificial Sequence
  synthetic
gggtttacattcgacgattacagc

SEQ ID NO: 1564 - protein, 8 aa, Artificial Sequence
  synthetic
GFTFDDYS

SEQ ID NO: 1565 - DNA, 24 bp, Artificial Sequence
  synthetic
atatcatggaactcaggaagcatc

SEQ ID NO: 1566 - protein, 8 aa, Artificial Sequence
  synthetic
ISWNSGSI

SEQ ID NO: 1567 - DNA, 51 bp, Artificial Sequence; identical to SEQ ID NO: 1543
  synthetic

SEQ ID NO: 1568 - protein, 17 aa, Artificial Sequence
  synthetic
AKYGSGYGKFYYYGLDV

SEQ ID NO: 1569 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttatcattatggaatggacgtgtggggacaagggacaacagtgacagtgagtagc

SEQ ID NO: 1570 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKYGSGYGKFYHYGMDVWGQGTTVTVSS

SEQ ID NO: 1571 - DNA, 24 bp, Artificial Sequence
  synthetic
gggtttacattcgacgattacagc

SEQ ID NO: 1572 - protein, 8 aa, Artificial Sequence
  synthetic
GFTFDDYS

SEQ ID NO: 1573 - DNA, 24 bp, Artificial Sequence
  synthetic
atatcatggaactcaggaagcatc

SEQ ID NO: 1574 - protein, 8 aa, Artificial Sequence
  synthetic
ISWNSGSI

SEQ ID NO: 1575 - DNA, 51 bp, Artificial Sequence; identical to SEQ ID NO: 1551
  synthetic

SEQ ID NO: 1576 - protein, 17 aa, Artificial Sequence
  synthetic
AKYGSGYGKFYHYGMDV

SEQ ID NO: 1577 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttattattatggactggacgtgtggggacaagggacaacagtgacagtgagtagc

SEQ ID NO: 1578 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKDGSGYGKFYYYGLDVWGQGTTVTVSS

SEQ ID NO: 1579 - DNA, 24 bp, Artificial Sequence
  synthetic
gggtttacattcgacgattacagc

SEQ ID NO: 1580 - protein, 8 aa, Artificial Sequence
  synthetic
GFTFDDYS

SEQ ID NO: 1581 - DNA, 24 bp, Artificial Sequence
  synthetic
atatcatggaactcaggaagcaag

SEQ ID NO: 1582 - protein, 8 aa, Artificial Sequence
  synthetic
ISWNSGSK

SEQ ID NO: 1583 - DNA, 51 bp, Artificial Sequence
  synthetic
gcaaaagacggcagtggttatggcaagttttattattatggactggacgtg

SEQ ID NO: 1584 - protein, 17 aa, Artificial Sequence
  synthetic
AKDGSGYGKFYYYGLDV

SEQ ID NO: 1585 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttatcattatggaatggacgtgtggggacaagggacaacagtgacagtgagtagc

SEQ ID NO: 1586 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKDGSGYGKFYHYGMDVWGQGTTVTVSS

SEQ ID NO: 1587 - DNA, 24 bp, Artificial Sequence
  synthetic
gggtttacattcgacgattacagc

SEQ ID NO: 1588 - protein, 8 aa, Artificial Sequence
  synthetic
GFTFDDYS

SEQ ID NO: 1589 - DNA, 24 bp, Artificial Sequence
  synthetic
atatcatggaactcaggaagcaag

SEQ ID NO: 1590 - protein, 8 aa, Artificial Sequence
  synthetic
ISWNSGSK

SEQ ID NO: 1591 - DNA, 51 bp, Artificial Sequence
  synthetic
gcaaaagacggcagtggttatggcaagttttatcattatggaatggacgtg

SEQ ID NO: 1592 - protein, 17 aa, Artificial Sequence
  synthetic
AKDGSGYGKFYHYGMDV

SEQ ID NO: 1593 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttattattatggaatggacgtgtggggacaagggacaacagtgacagtgagtagc

SEQ ID NO: 1594 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKYGSGYGKFYYYGMDVWGQGTTVTVSS

SEQ ID NO: 1595 - DNA, 24 bp, Artificial Sequence
  synthetic
gggtttacattcgacgattacagc

SEQ ID NO: 1596 - protein, 8 aa, Artificial Sequence
  synthetic
GFTFDDYS

SEQ ID NO: 1597 - DNA, 24 bp, Artificial Sequence
  synthetic
atatcatggaactcaggaagcaag

SEQ ID NO: 1598 - protein, 8 aa, Artificial Sequence
  synthetic
ISWNSGSK

SEQ ID NO: 1599 - DNA, 51 bp, Artificial Sequence
  synthetic
gcaaaatacggcagtggttatggcaagttttattattatggaatggacgtg

SEQ ID NO: 1600 - protein, 17 aa, Artificial Sequence
  synthetic
AKYGSGYGKFYYYGMDV

SEQ ID NO: 1601 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttattattatggactggacgtgtggggacaagggacaacagtgacagtgagtagc

SEQ ID NO: 1602 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGKFYYYGLDVWGQGTTVTVSS

SEQ ID NO: 1603 - DNA, 24 bp, Artificial Sequence
  synthetic
gggtttacattcgacgattacagc

SEQ ID NO: 1604 - protein, 8 aa, Artificial Sequence
  synthetic
GFTFDDYS

SEQ ID NO: 1605 - DNA, 24 bp, Artificial Sequence
  synthetic
atatcatggaactcaggaagcatc

SEQ ID NO: 1606 - protein, 8 aa, Artificial Sequence
  synthetic
ISWNSGSI

SEQ ID NO: 1607 - DNA, 51 bp, Artificial Sequence; identical to SEQ ID NO: 1583
  synthetic

SEQ ID NO: 1608 - protein, 17 aa, Artificial Sequence
  synthetic
AKDGSGYGKFYYYGLDV

SEQ ID NO: 1609 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttatcattatggaatggacgtgtggggacaagggacaacagtgacagtgagtagc

SEQ ID NO: 1610 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGKFYHYGMDVWGQGTTVTVSS

SEQ ID NO: 1611 - DNA, 24 bp, Artificial Sequence
  synthetic
gggtttacattcgacgattacagc

SEQ ID NO: 1612 - protein, 8 aa, Artificial Sequence
  synthetic
GFTFDDYS

SEQ ID NO: 1613 - DNA, 24 bp, Artificial Sequence
  synthetic
atatcatggaactcaggaagcatc

SEQ ID NO: 1614 - protein, 8 aa, Artificial Sequence
  synthetic
ISWNSGSI

SEQ ID NO: 1615 - DNA, 51 bp, Artificial Sequence; identical to SEQ ID NO: 1591
  synthetic

SEQ ID NO: 1616 - protein, 17 aa, Artificial Sequence
  synthetic
AKDGSGYGKFYHYGMDV

SEQ ID NO: 1617 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttattattatggaatggacgtgtggggacaagggacaacagtgacagtgagtagc

SEQ ID NO: 1618 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKYGSGYGKFYYYGMDVWGQGTTVTVSS

SEQ ID NO: 1619 - DNA, 24 bp, Artificial Sequence
  synthetic
gggtttacattcgacgattacagc

SEQ ID NO: 1620 - protein, 8 aa, Artificial Sequence
  synthetic
GFTFDDYS

SEQ ID NO: 1621 - DNA, 24 bp, Artificial Sequence
  synthetic
atatcatggaactcaggaagcatc

SEQ ID NO: 1622 - protein, 8 aa, Artificial Sequence
  synthetic
ISWNSGSI

SEQ ID NO: 1623 - DNA, 51 bp, Artificial Sequence; identical to SEQ ID NO: 1599
  synthetic

SEQ ID NO: 1624 - protein, 17 aa, Artificial Sequence
  synthetic
AKYGSGYGKFYYYGMDV

SEQ ID NO: 1625 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttattattatggaatggacgtgtggggacaagggacaacagtgacagtgagtagc

SEQ ID NO: 1626 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKDGSGYGKFYYYGMDVWGQGTTVTVSS

SEQ ID NO: 1627 - DNA, 24 bp, Artificial Sequence
  synthetic
gggtttacattcgacgattacagc

SEQ ID NO: 1628 - protein, 8 aa, Artificial Sequence
  synthetic
GFTFDDYS

SEQ ID NO: 1629 - DNA, 24 bp, Artificial Sequence
  synthetic
atatcatggaactcaggaagcaag

SEQ ID NO: 1630 - protein, 8 aa, Artificial Sequence
  synthetic
ISWNSGSK

SEQ ID NO: 1631 - DNA, 51 bp, Artificial Sequence
  synthetic
gcaaaagacggcagtggttatggcaagttttattattatggaatggacgtg

SEQ ID NO: 1632 - protein, 17 aa, Artificial Sequence
  synthetic
AKDGSGYGKFYYYGMDV

SEQ ID NO: 1633 - DNA, 372 bp, Artificial Sequence
  synthetic
gaagtgcagctggtggagtctgggggaggcttggtacagcctggcaggtccctgagactctcctgtgtagcctctggattcacctttgatgattattccatgcactgggtccggcaagctccagggaagggcctggagtgggtctcaggtattagttggaatagtggtagcaaagactatgcggactctgtgaagggccgattcaccatctccagagacaacgccaagaactccctgtatctgcaaatgaacagtctgagagctgaagacacggccttgtattactgtgcaaaatatggaagtggctacgggaagttctaccactacggtttggacgtctggggccaagggaccacggtcaccgtctcctca

SEQ ID NO: 1634 - protein, 124 aa, Artificial Sequence; identical to SEQ ID NO: 1258
  synthetic

SEQ ID NO: 1635 - DNA, 24 bp, Artificial Sequence
  synthetic
ggattcacctttgatgattattcc

SEQ ID NO: 1636 - protein, 8 aa, Artificial Sequence
  synthetic
GFTFDDYS

SEQ ID NO: 1637 - DNA, 24 bp, Artificial Sequence
  synthetic
attagttggaatagtggtagcaaa

SEQ ID NO: 1638 - protein, 8 aa, Artificial Sequence
  synthetic
ISWNSGSK

SEQ ID NO: 1639 - DNA, 51 bp, Artificial Sequence; identical to SEQ ID NO: 1263
  synthetic

SEQ ID NO: 1640 - protein, 17 aa, Artificial Sequence
  synthetic
AKYGSGYGKFYHYGLDV

SEQ ID NO: 1641 - DNA, 324 bp, Artificial Sequence; identical to SEQ ID NO: 145
  synthetic

SEQ ID NO: 1642 - protein, 108 aa, Artificial Sequence; identical to SEQ ID NO: 146
  synthetic

SEQ ID NO: 1643 - DNA, 18 bp, Artificial Sequence
  synthetic
cagagcattaacaactat

SEQ ID NO: 1644 - protein, 6 aa, Artificial Sequence
  synthetic
QSINNY

SEQ ID NO: 1645 - DNA, 9 bp, Artificial Sequence
  synthetic
actgcatcc

SEQ ID NO: 1646 - protein, 3 aa, Artificial Sequence
  synthetic
TAS

SEQ ID NO: 1647 - DNA, 30 bp, Artificial Sequence; identical to SEQ ID NO: 151
  synthetic

SEQ ID NO: 1648 - protein, 10 aa, Artificial Sequence
  synthetic
QQSFSTPPIT

SEQ ID NO: 1649 - protein, 207 aa, Artificial Sequence
  synthetic
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 1650 - protein, 171 aa, Artificial Sequence
  synthetic
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 1651 - protein, 750 aa, Artificial Sequence
  synthetic
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 1652 - protein, 207 aa, Artificial Sequence; identical to SEQ ID NO: 1649
  synthetic

SEQ ID NO: 1653 - protein, 171 aa, Artificial Sequence; identical to SEQ ID NO: 1650
  synthetic

SEQ ID NO: 1654 - protein, 750 aa, Artificial Sequence; identical to SEQ ID NO: 1651
  synthetic

SEQ ID NO: 1655 - protein, 25 aa, Artificial Sequence [sequence omitted]

SEQ ID NO: 1656 - protein, 17 aa, Artificial Sequence
  synthetic
MHWVRQAPGKGLEWVSG

SEQ ID NO: 1657 - protein, 38 aa, Artificial Sequence
  synthetic
GYADSVKGRFTISRDNAKNSLYLQMNSLRAEDTALYYC

SEQ ID NO: 1658 - protein, 11 aa, Artificial Sequence
  synthetic
WGQGTTVTVSS

SEQ ID NO: 1659 - protein, 8 aa, Artificial Sequence
  synthetic
  VARIANT 8: Xaa = Any Amino Acid
GFTFDDYX

SEQ ID NO: 1660 - protein, 8 aa, Artificial Sequence
  synthetic
  VARIANT 8: Xaa = Any Amino Acid
ISWNSGSX

SEQ ID NO: 1661 - protein, 17 aa, Artificial Sequence
  synthetic
  VARIANT 3, 12, 15: Xaa = Any Amino Acid
AKXGSGYGKFYXYGXDV

SEQ ID NO: 1662 - protein, 125 aa, Artificial Sequence
  synthetic
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDGYSGYGYFYYYGMDVWGQGTTVTVSS

SEQ ID NO: 1663 - protein, 330 aa, Artificial Sequence [sequence omitted]

SEQ ID NO: 1664 - protein, 330 aa, Artificial Sequence
  synthetic
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1665 - protein, 326 aa, Artificial Sequence
  synthetic
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 1666 - protein, 326 aa, Artificial Sequence
  synthetic
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNRFTQKSLSLSPGK

SEQ ID NO: 1667 - protein, 327 aa, Artificial Sequence
  synthetic
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1668 - protein, 327 aa, Artificial Sequence
  synthetic
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNRFTQKSLSLSLGK

SEQ ID NO: 1669 - protein, 329 aa, Artificial Sequence
  synthetic
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1670 - protein, 329 aa, Artificial Sequence
  synthetic
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1671 - protein, 326 aa, Artificial Sequence
  synthetic
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1672 - protein, 326 aa, Artificial Sequence
  synthetic
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNRFTQKSLSLSLGK

SEQ ID NO: 1673 - protein, 232 aa, Artificial Sequence
  synthetic
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1674 - protein, 232 aa, Artificial Sequence
  synthetic
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1675 - protein, 228 aa, Artificial Sequence
  synthetic
ERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 1676 - protein, 228 aa, Artificial Sequence
  synthetic
ERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNRFTQKSLSLSPGK

SEQ ID NO: 1677 - protein, 229 aa, Artificial Sequence
  synthetic
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNRFTQKSLSLSLGK

SEQ ID NO: 1678 - protein, 229 aa, Artificial Sequence
  synthetic
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1679 - protein, 231 aa, Artificial Sequence
  synthetic
EPKSCDKTHTCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1680 - protein, 231 aa, Artificial Sequence
  synthetic
EPKSCDKTHTCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1681 - protein, 228 aa, Artificial Sequence
  synthetic
ESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1682 - protein, 228 aa, Artificial Sequence
  synthetic
ESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNRFTQKSLSLSLGK

SEQ ID NO: 1683 - protein, 227 aa, Artificial Sequence
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1684 - protein, 227 aa, Artificial Sequence
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1685 - protein, 233 aa, Artificial Sequence
  synthetic
EPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNRFTTKSFSRTPGK

SEQ ID NO: 1686 - protein, 233 aa, Artificial Sequence
  synthetic
EPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

What is claimed is:

1. A fully human bispecific antigen-binding molecule comprising a first antigen-binding domain that specifically binds human CD3, and a second antigen-binding domain that specifically binds human PSMA, wherein:

(i) the first antigen-binding domain comprises one heavy chain polypeptide and one light chain polypeptide, and the second antigen-binding domain comprises one heavy chain polypeptide and one light chain polypeptide, wherein the second antigen-binding domain that specifically binds human PSMA comprises the heavy chain complementarity determining regions (HCDR1, HCDR2 and HCDR3) from a heavy chain variable region (HCVR) comprising the amino acid sequence of SEQ ID NO: 122, and the light chain complementarity determining regions (LCDR1, LCDR2 and LCDR3) from a light chain variable region (LCVR) comprising the amino acid sequence of SEQ ID NO: 930, and (ii) the bispecific antigen-binding molecule induces T cell-mediated cell killing of PSMA-expressing cells.

2. The bispecific antigen-binding molecule of claim 1, wherein the antigen-binding molecule inhibits tumor growth in immunocompetent mice bearing human prostate cancer xenografts.

3. The bispecific antigen-binding molecule of claim 1, wherein the first antigen-binding domain that specifically binds human CD3 comprises heavy chain complementarity determining regions (HCDR1, HCDR2 and HCDR3) from a heavy chain variable region (HCVR) comprising the amino acid sequence of SEQ ID NO: 922, and light chain complementarity determining regions (LCDR1, LCDR2 and LCDR3) from a light chain variable region (LCVR) comprising the amino acid sequence of SEQ ID NO: 930.

4. The bispecific antigen-binding molecule of claim 1, wherein the first antigen-binding domain that specifically binds human CD3 comprises three heavy chain complementarity determining regions (A1-HCDR1, A1-HCDR2 and A1-HCDR3) and three light chain complementarity determining regions (A1-LCDR1, A1-LCDR2 and A1-LCDR3), and wherein the second antigen-binding domain that specifically binds human PSMA comprises three heavy chain complementarity determining regions (A2-HCDR1, A2-HCDR2 and A2-HCDR3) and three light chain complementarity determining regions (A2-LCDR1, A2-LCDR2 and A2-LCDR3);

wherein A1-HCDR1 comprises the amino acid sequence of SEQ ID NO: 924; A1-HCDR2 comprises the amino acid sequence of SEQ ID NO: 926; A1-HCDR3 comprises the amino acid sequence of SEQ ID NO: 928; A1-LCDR1 comprises the amino acid sequence of SEQ ID NO: 932; A1-LCDR2 comprises the amino acid sequence of SEQ ID NO: 934; and A1-LCDR3 comprises the amino acid sequence of SEQ ID NO: 936; and wherein A2-HCDR1 comprises the amino acid sequence of SEQ ID NO: 124; A2-HCDR2 comprises the amino acid sequence of SEQ ID NO: 126; A2-HCDR3 comprises the amino acid sequence of SEQ ID NO: 128; A2-LCDR1 comprises the amino acid sequence of SEQ ID NO: 932; A2-LCDR2 comprises the amino acid sequence of SEQ ID NO: 934; and A2-LCDR3 comprises the amino acid sequence of SEQ ID NO: 936.

5. A pharmaceutical composition comprising the bispecific antigen-binding molecule of claim 1 and a pharmaceutically acceptable carrier or diluent.

6. A bispecific antigen-binding molecule comprising a first antigen-binding domain that specifically binds human CD3 and comprises the complementarity determining regions (CDRs) of a heavy chain variable region/light chain variable region (HCVR/LCVR) pair comprising the amino acid sequences of SEQ ID NOs: 922/930; and a second antigen-binding domain that specifically binds human PSMA and comprises the CDRs of a HCVR/LCVR pair comprising the amino acid sequences of SEQ ID NOs: 122/930.

7. The bispecific antigen-binding molecule of claim 6, wherein the first antigen-binding domain that specifically binds human CD3 comprises a heavy chain variable region/light chain variable region (HCVR/LCVR) pair comprising the amino acid sequences of SEQ ID NOs: 922/930, and the second antigen-binding domain that specifically binds human PSMA comprises a HCVR/LCVR pair comprising the amino acid sequences of SEQ ID NOs: 122/930.

8. A pharmaceutical composition comprising the bispecific antigen-binding molecule of claim 6 and a pharmaceutically acceptable carrier or diluent.

9. The bispecific antigen-binding molecule of claim 6 that is a bispecific antibody.

10. A pharmaceutical composition comprising the bispecific antigen-binding molecule of claim 4 and a pharmaceutically acceptable carrier or diluent.

11. A pharmaceutical composition comprising the bispecific antigen-binding molecule of claim 7 and a pharmaceutically acceptable carrier or diluent.

12. A pharmaceutical composition comprising the bispecific antibody of claim 9 and a pharmaceutically acceptable carrier or diluent.

* * * * *